US010591481B2

(12) United States Patent
Orren et al.

(10) Patent No.: US 10,591,481 B2
(45) Date of Patent: Mar. 17, 2020

(54) METHODS OF MEASURING FACTOR D ACTIVITY AND POTENCY OF FACTOR D INHIBITORS

(71) Applicant: GENENTECH, INC., South San Francisco, CA (US)

(72) Inventors: Linda Orren, Half Moon Bay, CA (US); Aaron Miller, South San Francisco, CA (US); Xiaoqing Jia, Shanghai (CN); Pin Yee Wong, South San Francisco, CA (US)

(73) Assignee: Genentech, Inc., South San Francisco, CA (US)

( * ) Notice: Subject to any disclaimer, the term of this patent is extended or adjusted under 35 U.S.C. 154(b) by 494 days.

(21) Appl. No.: 15/336,081

(22) Filed: Oct. 27, 2016

(65) Prior Publication Data
US 2017/0122944 A1 May 4, 2017

Related U.S. Application Data

(60) Provisional application No. 62/250,885, filed on Nov. 4, 2015, provisional application No. 62/249,073, filed on Oct. 30, 2015.

(51) Int. Cl.
G01N 33/53 (2006.01)
G01N 33/573 (2006.01)
G01N 33/542 (2006.01)
C12Q 1/37 (2006.01)

(52) U.S. Cl.
CPC .......... G01N 33/573 (2013.01); C12Q 1/37 (2013.01); C12Y 304/21046 (2013.01); G01N 33/542 (2013.01); G01N 2333/4716 (2013.01); G01N 2333/96433 (2013.01); G01N 2500/02 (2013.01); G01N 2500/04 (2013.01); G01N 2500/20 (2013.01)

(58) Field of Classification Search
None
See application file for complete search history.

(56) References Cited

U.S. PATENT DOCUMENTS

2013/0296377 A1* 11/2013 Adams ............... C07D 491/048
514/338
2013/0337045 A1* 12/2013 Bredehorst .......... A61K 9/0024
424/450
2015/0182588 A1* 7/2015 Kahvejian .......... A61K 47/6901
424/1.69

FOREIGN PATENT DOCUMENTS

WO WO 2014/028861 A1 2/2014
WO WO 2014/055835 A1 4/2014
WO WO 2016/151558 A1 9/2016

OTHER PUBLICATIONS

Inagi et al., "Evaluation of the Proteolytic Activity of Factor D Accumulated as an Active Serine Protease on Patients with Chronic Renal Failure," *Nephron*, 66(3): 285-290 (1994).
Tanhehco et al., "The Anti-Factor D Antibody, Mab 166-32, Inhibits the Alternative Pathway of the Human Complement System," *Transplantation Proceedings*, 31(5): 2168-2171 (1999).
Volanakis and Narayana, "Complement factor D, a novel serine protease," *Protein Science*, 5: 553-564 (1996).
Katschke et al., "Inhibiting Alternative Pathway Complement Activation by Targeting the Factor D Exosite," *The Journal of Biological Chemistry*, 287(16): 12886-12892 (2012).
Damico et al., "New approaches and potential treatments for dry age-related macular degeneration," *Arq. Bras. Oftalmol.*, 75(1): 71-75 (2012).
International Search Report dated Mar. 20, 2017 of PCT/US2016/059045, now WO 2017/075170 (8 pages).
Written Opinion dated Mar. 20, 2017 of PCT/US2016/059045, now WO 2017/075170 (13 pages).

\* cited by examiner

*Primary Examiner* — Gary Counts
(74) *Attorney, Agent, or Firm* — McNeill Baur PLLC

(57) ABSTRACT

Methods of measuring the activity of Factor D, the key driver in the activation of the alternative complement pathway, methods of determining the potency of Factor D inhibitors, and methods of screening for Factor D inhibitors are provided.

48 Claims, 5 Drawing Sheets

Specification includes a Sequence Listing.

METHODS OF MEASURING FACTOR D ACTIVITY AND POTENCY OF FACTOR D INHIBITORS

CROSS-REFERENCE TO RELATED APPLICATIONS

This application claims the benefit of U.S. Provisional Application Nos. 62/249,073, filed on Oct. 30, 2015, and 62/250,885, filed Nov. 4, 2015, which are incorporated by reference herein in their entireties.

REFERENCE TO SEQUENCE LISTING SUBMITTED ELECTRONICALLY

This application incorporates by reference a Sequence Listing submitted with this application as a text file entitled "12279-705-999_SEQLIST.txt" created on Oct. 27, 2016 and having a size of 1,647,547 bytes.

1. FIELD

The invention relates to methods of measuring the activity of Factor D, the key driver in the activation of the alternative complement pathway, methods of determining the potency of Factor D inhibitors, and methods of screening for Factor D inhibitors.

2. BACKGROUND

Factor D is a highly specific chymotrypsin like serine protease that is a rate limiting enzyme in the activation of the complement alternative pathway (Katsche et al., 2012, J Biol Chem 287:12886-12892). Increased activation of the alternative complement pathway has been found in drusen, cytotoxic deposits present on the Bruch's membrane, which are associated with the development of age related macular degeneration (AMD) (Damico et al., 2012, Arq Bras Oftalmol 75:71-75).

Inhibitors of Factor D are being developed as therapeutics to prevent activation of the alternative complement pathway, thereby inhibiting inflammation and cytotoxic activity of the activated complement components (Tanhehco, 1999, Transplant Proc 31:2168-2171).

Activation of the alternative complement pathway is typically measured by adding human serum to rabbit erythrocytes. Next, intact erythrocytes and cellular debris are pelleted by centrifugation and lysis is determined by measuring the absorbance at 412 nm arising from the release of hemoglobin into the supernatant.

Citation of a reference herein shall not be construed as an admission that such is prior art to the present disclosure.

3. SUMMARY OF THE INVENTION

The invention relates to methods of measuring Factor D activity, methods of determining the potency of Factor D inhibitors, and methods of screening for Factor D inhibitors, all of which comprise measuring Factor B cleavage using a proximity-based measurement assay. The methods are simple, fast, homogeneous and adaptable to high-throughput assays, and are based in part on the inventors' development and characterization of an assay that measures the ability of lampalizumab (an anti-Factor D antibody) to inhibit the enzymatic activity of Factor D (see Section 6). The substrate for Factor D is another alternative complement pathway serine protease, Factor B. Factor C3b binds to Factor B; then, Factor D cleaves Factor B into Factor Ba and Factor Bb. Factor Bb remains bound to Factor C3b, forming the active C3 convertase, which initiates the alternative complement pathway (Volanakis, et al., 1996, Protein Science 5:553-564). Therefore, if Factor B is not cleaved by Factor D, Factor Ba and Factor Bb will be in spatial proximity with each other, Factor C3b and Factor Ba will also be in spatial proximity with each other. When Factor B is cleaved by Factor D, however, Factor Ba and Factor Bb will be apart from each other, and Factor C3b and Factor Ba will also be apart from each other.

In certain embodiments, the methods described herein rely on the distance between Factor Ba and Factor Bb, wherein one of the two is labeled with a donor, and the other is labeled with an acceptor. In such embodiments, the donor and/or the acceptor may be attached to Factor Ba or Factor Bb, respectively, by a protein (e.g., an antibody or antigen-binding fragment thereof), peptide, peptide mimetic, aptamer, nucleotide (e.g., DNA, RNA, shRNA, miRNA, siRNA, antisense DNA), or any other molecule that binds to Factor Ba or Factor Bb, or by direct chemical labeling (when the donor is attached to Factor Ba, the acceptor is attached to Factor Bb; when the donor is attached to Factor Bb, the acceptor is attached to Factor Ba).

In certain embodiments, the methods described herein rely on the distance between Factor C3b and Factor Ba, wherein one of the two is labeled with a donor, and the other is labeled with an acceptor. In such embodiments, the donor and/or the acceptor may be attached to Factor C3b or Factor Ba, respectively, by a protein (e.g., an antibody or antigen-binding fragment thereof), peptide, peptide mimetic, aptamer, nucleotide (e.g., DNA, RNA, shRNA, miRNA, siRNA, antisense DNA), or any other molecule that binds to Factor C3b or Factor Ba, or by direct chemical labeling (when the donor is attached to Factor C3b, the acceptor is attached to Factor Ba; when the donor is attached to Factor Ba, the acceptor is attached to Factor C3b).

To more precisely measure Factor D activity or the potency of Factor D inhibitors, a quencher can be added to terminate the enzymatic cleavage of Factor B by Factor D before measuring. Luckily, the inventors have discovered that when both anti-Factor Ba and anti-Factor Bb are used as detection reagents, they quench the Factor D activity in the assay, therefore obviating the need to add another quencher.

The methods of measuring Factor D activity are useful, for example, in diagnosing or staging a human patient having or suspected of having a disorder associated with increased or decreased Factor D activity relative to a normal person. The methods of determining the potency of Factor D inhibitors are useful, for example, in assessing the quality of anti-Factor D therapeutics for quality control in batch manufacturing, and in testing the potency of selected anti-Factor D therapeutic leads. The methods of screening for Factor D inhibitors are useful, for example, in high-throughput screening for new Factor D inhibitors.

In one aspect, provided herein are methods of measuring the activity of Factor D in a sample derived from a subject (e.g., a human), comprising performing a proximity-based measurement assay, wherein the proximity-based measurement assay measures the cleavage of Factor B.

In various embodiments, the methods of measuring the activity of Factor D comprise (a) adding to the sample an anti-Factor Ba antibody labeled with a first moiety and an anti-Factor Bb antibody labeled with a second moiety, wherein one of the moieties is a donor, and the other moiety is an acceptor, and wherein a proximity signal generated by the acceptor and/or the donor indicates that Factor Ba and Factor Bb are in proximity; and (b) measuring the value of the proximity signal from the sample; wherein the activity of Factor D in the sample is negatively correlated with the value of the proximity signal. In some embodiments, the methods further comprise a step of quenching the activity of Factor D in the sample by providing an excessive amount of a quencher (e.g., a Factor D inhibitor) to the sample before the step of (a).

In certain aspects of such various embodiments, the methods of measuring the activity of Factor D further comprise: (c) adding to a control sample the anti-Factor Ba antibody labeled with the first moiety and the anti-Factor Bb antibody labeled with the second moiety; and (d) measuring the value of the proximity signal from the control sample; wherein a greater value of the proximity signal from the sample relative to the control sample indicates a lower activity of Factor D in the sample relative to the control sample. In some embodiments, the methods further comprise a step of quenching the activity of Factor D in the sample by providing an excessive amount of a quencher (e.g., a Factor D inhibitor) to the sample before the step of (a), and a step of quenching the activity of Factor D in the control sample by providing an excessive amount of the quencher to the control sample before the step of (c).

In some embodiments of the methods of measuring the activity of Factor D as described, the anti-Factor Ba antibody and the anti-Factor Bb antibody quench the activity of Factor D.

In other various embodiments, the methods of measuring the activity of Factor D comprise (a) adding to the sample an anti-Factor C3b antibody labeled with a first moiety and an anti-Factor Ba antibody labeled with a second moiety, wherein one of the moieties is a donor, and the other moiety is an acceptor, and wherein a proximity signal generated by the acceptor and/or the donor indicates that Factor C3b and Factor Ba are in proximity; and (b) measuring the value of the proximity signal from the sample; wherein the activity of Factor D in the sample is negatively correlated with the value of the proximity signal. In some embodiments, the methods further comprise a step of quenching the activity of Factor D in the sample by providing an excessive amount of a quencher (e.g., a Factor D inhibitor) to the sample before the step of (a).

In certain aspects of such other various embodiments, the methods of measuring the activity of Factor D further comprise: (c) adding to a control sample the anti-Factor C3b antibody labeled with the first moiety and the anti-Factor Ba antibody labeled with the second moiety; and (d) measuring the value of the proximity signal from the control sample; wherein a greater value of the proximity signal from the sample relative to the control sample indicates a lower activity of Factor D in the sample relative to the control sample. In some embodiments, the methods further comprise a step of quenching the activity of Factor D in the sample by providing an excessive amount of a quencher (e.g., a Factor D inhibitor) to the sample before the step of (a), and a step of quenching the activity of Factor D in the control sample by providing an excessive amount of the quencher to the control sample before the step of (c).

In specific embodiments of the methods of measuring the activity of Factor D described herein, the Factor B is a recombinantly expressed Factor B. In specific embodiments of the methods of measuring the activity of Factor D described herein, the Factor B is endogenously expressed Factor B purified from a sample derived from a subject.

In another aspect, provided herein are methods of determining the potency of a Factor D inhibitor in inhibiting Factor D activity, comprising performing a proximity-based measurement assay, wherein the proximity-based measurement assay measures the cleavage of Factor B.

In various embodiments, the methods of determining the potency of a Factor D inhibitor comprise: (a) mixing the Factor D inhibitor with Factor D, Factor B and Factor C3b in a test reaction mix; (b) incubating the test reaction mix; (c) adding to the test reaction mix an anti-Factor Ba antibody labeled with a first moiety and an anti-Factor Bb antibody labeled with a second moiety after the step of (b), wherein one of the moieties is a donor, and the other moiety is an acceptor, and wherein a proximity signal generated by the acceptor and/or the donor indicates that Factor Ba and Factor Bb are in proximity; and (d) measuring the value of the proximity signal from the test reaction mix; wherein the potency of the Factor D inhibitor is positively correlated with the value of the proximity signal. In some embodiments, the methods further comprise a step of quenching the activity of Factor D in the sample by providing an excessive amount of a quencher (e.g., a Factor D inhibitor) to the sample before the step of (c).

In certain aspects of such various embodiments, the methods of determining the potency of a Factor D inhibitor further comprise: (e) mixing a control reaction mix; (f) incubating the control reaction mix; (g) adding to the control reaction mix the anti-Factor Ba antibody labeled with the first moiety and the anti-Factor Bb antibody labeled with the second moiety after the step of (f); and (h) measuring the value of the proximity signal from the control test reaction mix; wherein a greater value of the proximity signal from the test reaction mix relative to the control reaction mix indicates a greater inhibition of Factor D activity by the Factor D inhibitor in the test reaction mix relative to the control reaction mix. In some embodiments, the methods further comprise a step of quenching the activity of Factor D in the sample by providing an excessive amount of a quencher (e.g., a Factor D inhibitor) to the sample before the step of (c), and a step of quenching the activity of Factor D in the control sample by providing an excessive amount of the quencher to the control sample before the step of (g).

In some embodiments of the methods of determining the potency of a Factor D inhibitor, the anti-Factor Ba antibody and the anti-Factor Bb antibody quench the activity of Factor D.

In other various embodiments, the methods of determining the potency of a Factor D inhibitor comprise: (a) mixing the Factor D inhibitor with Factor D, Factor B and Factor C3b in a test reaction mix; (b) incubating the test reaction mix; (c) adding to the test reaction mix an anti-Factor C3b antibody labeled with a first moiety and an anti-Factor Ba antibody labeled with a second moiety after the step of (b), wherein one of the moieties is a donor, and the other moiety is an acceptor, and wherein a proximity signal generated by the acceptor and/or the donor indicates that Factor C3b and Factor Ba are in proximity; and (d) measuring the value of the proximity signal from the test reaction mix; wherein the potency of the Factor D inhibitor is positively correlated with the value of the proximity signal. In some embodiments, the methods further comprise a step of quenching the activity of Factor D in the sample by providing an excessive amount of a quencher (e.g., a Factor D inhibitor) to the sample before the step of (c).

In certain aspects of such other various embodiments, the methods of determining the potency of a Factor D inhibitor further comprise: (e) mixing a control reaction mix; (f) incubating the control reaction mix; (g) adding to the control reaction mix the anti-Factor C3b antibody labeled with the first moiety and the anti-Factor Ba antibody labeled with the second moiety after the step of (f); and (h) measuring the value of the proximity signal from the control test reaction mix; wherein a greater value of the proximity signal from the test reaction mix relative to the control reaction mix indicates a greater inhibition of Factor D activity by the Factor D inhibitor in the test reaction mix relative to the control reaction mix. In some embodiments, the methods further comprise a step of quenching the activity of Factor D in the sample by providing an excessive amount of a quencher (e.g., a Factor D inhibitor) to the sample before the step of (c), and a step of quenching the activity of Factor D in the control sample by providing an excessive amount of the quencher to the control sample before the step of (g).

In specific embodiments of the methods of determining the potency of a Factor D inhibitor, the Factor D inhibitor is an antibody or an antigen-binding fragment thereof (e.g., lampalizumab).

In specific embodiments, the antibody comprises one, two, three, four, five or six of the following HVRs: (i) an HVR-H1 comprising the amino acid sequence of SEQ ID NO: 1; (ii) an HVR-H2 comprising the amino acid sequence of SEQ ID NO: 2, SEQ ID NO: 3, or SEQ ID NO: 4; (iii) an HVR-H3 comprising the amino acid sequence of SEQ ID NO: 5, SEQ ID NO:6, SEQ ID NO: 7, or SEQ ID NO: 8; (iv) an HVR-L1 comprising the amino acid sequence of SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, or SEQ ID NO: 17; (v) an HVR-L2 comprising the amino acid sequence of SEQ ID NO: 18; or (vi) an HVR-L3 comprising the amino acid sequence of SEQ ID NO: 19 or SEQ ID NO: 20.

In specific embodiments, the antibody comprises one, two, three, four, five or six of the following HVRs: (i) an HVR-H1 comprising the amino acid sequence of SEQ ID NO: 85; (ii) an HVR-H2 comprising the amino acid sequence of SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, or SEQ ID NO: 94; (iii) an HVR-H3 comprising the amino acid sequence of SEQ ID NO: 95; (iv) an HVR-L1 comprising the amino acid sequence of SEQ ID NO: 96; (v) an HVR-L2 comprising the amino acid sequence of SEQ ID NO: 97, SEQ ID NO: 98, or SEQ ID NO: 99; or (vi) an HVR-L3 comprising the amino acid sequence of SEQ ID NO: 100 or SEQ ID NO: 101.

In specific embodiments of the methods of determining the potency of a Factor D inhibitor described herein, the Factor D is a recombinantly expressed Factor D. In specific embodiments of the methods of determining the potency of a Factor D inhibitor described herein, the Factor D is endogenously expressed Factor D purified from a sample derived from a subject.

In specific embodiments of the methods of determining the potency of a Factor D inhibitor described herein, the Factor B is a recombinantly expressed Factor B. In specific embodiments of the methods of determining the potency of a Factor D inhibitor described herein, the Factor B is endogenously expressed Factor B purified from a sample derived from a subject.

In another aspect, provided herein are methods of screening for a Factor D inhibitor from a plurality of Factor D inhibitor candidates, comprising performing a proximity-based measurement assay, wherein the proximity-based measurement assay measures the cleavage of Factor B.

In various embodiments, the methods of screening for a Factor D inhibitor comprise: (a) mixing a Factor D inhibitor candidate with Factor D, Factor B and Factor C3b in a test reaction mix; (b) incubating the test reaction mix; (c) adding to the test reaction mix an anti-Factor Ba antibody labeled with a first moiety and an anti-Factor Bb antibody labeled with a second moiety after the step of (b), wherein one of the moieties is a donor, and the other is an acceptor, and wherein a proximity signal generated by the acceptor and/or the donor indicates that Factor Ba and Factor Bb are in proximity; and (d) measuring the value of the proximity signal from the test reaction mix; wherein the degree of Factor D activity inhibition by a Factor D candidate is positively correlated with the value of the proximity signal. In some embodiments, the methods further comprise a step of quenching the activity of Factor D in the sample by providing an excessive amount of a quencher (e.g., a Factor D inhibitor) to the sample before the step of (c).

In certain aspects of such various embodiments, the methods of screening for a Factor D inhibitor further comprise: (e) mixing a control reaction mix; (f) incubating the control reaction mix; (g) adding to the control reaction mix the anti-Factor Ba antibody labeled with the first moiety and the anti-Factor Bb antibody labeled with the second moiety after the step of (f); and (h) measuring the value of the proximity signal from the control test reaction mix; wherein a greater value of the proximity signal from the test reaction mix relative to the control reaction mix indicates a greater inhibition of Factor D activity by the Factor D inhibitor candidate in the test reaction mix relative to the control reaction mix. In some embodiments, the methods further comprise a step of quenching the activity of Factor D in the sample by providing an excessive amount of a quencher to the sample before the step of (c), and a step of quenching the activity of Factor D in the control sample by providing an excessive amount of the quencher (e.g., a Factor D inhibitor) to the control sample before the step of (g).

In some embodiments of the methods of screening for a Factor D inhibitor, the anti-Factor Ba antibody and the anti-Factor Bb antibody quench the activity of Factor D.

In other various embodiments, the methods of screening for a Factor D inhibitor comprise: (a) mixing a Factor D inhibitor candidate with Factor D, Factor B and Factor C3b in a test reaction mix; (b) incubating the test reaction mix; (c) adding to the test reaction mix an anti-Factor C3b antibody labeled with a first moiety and an anti-Factor Ba antibody labeled with a second moiety after the step of (b), wherein one of the moieties is a donor, and the other is an acceptor, and wherein a proximity signal generated by the acceptor and/or the donor indicates that Factor C3b and Factor Ba are in proximity; and (d) measuring the value of the proximity signal from the test reaction mix; wherein the degree of Factor D activity inhibition by a Factor D candidate is positively correlated with the value of the proximity signal. In some embodiments, the methods further comprise a step of quenching the activity of Factor D in the sample by providing an excessive amount of a quencher (e.g., a Factor D inhibitor) to the sample before the step of (c).

In certain aspects of such other various embodiments, the methods of screening for a Factor D inhibitor further comprise: (e) mixing a control reaction mix; (f) incubating the control reaction mix; (g) adding to the control reaction mix the anti-Factor C3b antibody labeled with the first moiety and the anti-Factor Ba antibody labeled with the second moiety after the step of (f); and (h) measuring the value of the proximity signal from the control test reaction mix; wherein a greater value of the proximity signal from the test reaction mix relative to the control reaction mix indicates a greater inhibition of Factor D activity by the Factor D inhibitor candidate in the test reaction mix relative to the control reaction mix. In some embodiments, the methods further comprise a step of quenching the activity of Factor D in the sample by providing an excessive amount of a quencher to the sample before the step of (c), and a step of quenching the activity of Factor D in the control sample by providing an excessive amount of the quencher (e.g., a Factor D inhibitor) to the control sample before the step of (g).

In specific embodiments of the methods of screening for a Factor D inhibitor, the steps of (a)-(d) are carried out for each Factor D inhibitor candidate from the plurality.

In specific embodiments of the methods of screening for a Factor D inhibitor, the proximity-based measurement assay is carried out in a microplate.

In specific embodiments of the methods of screening for a Factor D inhibitor, the proximity-based measurement assay is conducted in a high-throughput manner.

In specific embodiments of the methods of screening for a Factor D inhibitor, the Factor D inhibitor candidate is an antibody or an antigen-binding fragment thereof (e.g., lampalizumab).

When anti-Factor Ba antibody and anti-Factor Bb antibody are used, in some embodiments of the methods described above, the anti-Factor Ba antibody is biotinylated, and the first moiety comprises streptavidin, avidin, or neutravidin (preferably streptavidin). In other embodiments, the anti-Factor Ba antibody is directly conjugated to the first moiety. In some embodiments, the anti-Factor Bb antibody is biotinylated, and the second moiety comprises streptavidin, avidin, or neutravidin (preferably streptavidin). In other embodiments, the anti-Factor Bb antibody is directly conjugated to the second moiety.

When anti-Factor C3b antibody and anti-Factor Ba antibody are used, in some embodiments of the methods described above, the anti-Factor C3b antibody is biotinylated, and the first moiety comprises streptavidin, avidin, or neutravidin (preferably streptavidin). In other embodiments, the anti-Factor C3b antibody is directly conjugated to the first moiety. In some embodiments, the anti-Factor Ba antibody is biotinylated, and the second moiety comprises streptavidin, avidin, or neutravidin (preferably streptavidin). In other embodiments, the anti-Factor Ba antibody is directly conjugated to the second moiety.

In certain embodiments of the methods described above, the donor and/or the acceptor is in the form of beads (e.g., AlphaScreen® beads).

In certain embodiments of the methods described above, the donor comprises Europium, the acceptor comprises Alexa Fluor® 647 dye, and the light source has a wavelength of about 340 nm.

In specific embodiments of the methods of screening for a Factor D inhibitor described herein, the Factor D is a recombinantly expressed Factor D. In specific embodiments of the methods of screening for a Factor D inhibitor described herein, the Factor D is endogenously expressed Factor D purified from a sample derived from a subject.

In specific embodiments of the methods of screening for a Factor D inhibitor described herein, the Factor B is a recombinantly expressed Factor B. In specific embodiments of the methods of screening for a Factor D inhibitor described herein, the Factor B is endogenously expressed Factor B purified from a sample derived from a subject.

In another aspect, provided herein are kits for measuring Factor D activity, determining Factor D inhibitor potency, and/or screening for Factor D inhibitors.

In various embodiments, the kits comprise an anti-Factor Ba antibody, an anti-Factor Bb antibody, a first moiety and a second moiety, wherein: (a) the anti-Factor Ba antibody is labeled or can be labeled with the first moiety, the anti-Factor Bb antibody is labeled or can be labeled with the second moiety; and (b) one of the moieties is a donor, and the other moiety is an acceptor.

In specific embodiments, the anti-Factor Ba antibody and/or the anti-Factor Bb antibody is immobilized on a solid surface. In specific embodiments, the solid surface is a plate, a microplate, a chip, a membrane, or a bead.

In other various embodiments, the kits comprise an anti-Factor C3b antibody, an anti-Factor Ba antibody, a first moiety and a second moiety, wherein: (a) the anti-Factor C3b antibody is labeled or can be labeled with the first moiety, the anti-Factor Ba antibody is labeled or can be labeled with the second moiety; and (b) one of the moieties is a donor, and the other moiety is an acceptor.

In specific embodiments, the anti-Factor C3b antibody and/or the anti-Factor Ba antibody is immobilized on a solid surface. In specific embodiments, the solid surface is a plate, a microplate, a chip, a membrane, or a bead.

In certain embodiments, the kits described herein further comprise a control sample with known Factor D activity.

In certain embodiments, the kits described herein further comprise a control Factor D inhibitor with known potency of inhibiting Factor D activity.

In certain embodiments, the kits described herein further comprise a quencher. In specific embodiments, the quencher is a Factor D inhibitor.

In specific embodiments, the kits described herein further comprise a recombinantly expressed Factor B. In specific embodiments, the kits described herein further comprise an endogenously expressed Factor B purified from a sample derived from a subject.

In specific embodiments, the kits described herein further comprise a recombinantly expressed Factor D. In specific embodiments, the kits described herein further comprise an endogenously expressed Factor D purified from a sample derived from a subject.

3.1. Definitions

The terms used throughout this application are to be construed with ordinary and typical meaning to those of ordinary skill in the art. However, the following definitions are provided in order to facilitate an understanding of the invention.

The phrase "proximity signal" refers to a signal that is generated by an acceptor and/or a donor when the acceptor and the donor (each of which is part of, binds to, or is attached to one member of a protein pair) are brought to close proximity. The value of the proximity signal is sensitive to the distance between the acceptor and the donor. In some embodiments, the proximity signal is a signal generated by the acceptor and the donor which indicates that the acceptor and the donor (and thus the protein pair) are in proximity. In some embodiments, the proximity signal is a signal generated by the acceptor which indicates that the acceptor and the donor (and thus the protein pair) are in proximity. In some embodiments, the proximity signal is a signal generated by the donor which indicates that the acceptor and the donor (and thus the protein pair) are in proximity. For example, when the Fluorescence Resonance Energy Transfer (FRET) technology is utilized to assay the distance between the donor and the acceptor, the proximity signal can be the ratio between the FRET acceptor's fluorescence emission intensity and the FRET donor's fluorescence emission intensity that is higher than a baseline level (e.g., about 2-fold, 5-fold, 10-fold, 20-fold, 50-fold, 100-fold higher or more) (a baseline level here is the ratio between the FRET acceptor's fluorescence emission intensity and the FRET donor's fluorescence emission intensity when the FRET acceptor and the FRET donor are apart (e.g., more than 10 nm, 20 nm, 50 nm, 100 nm, or 200 nm apart)). In another example, when the AlphaScreen® technology is utilized to assay the distance between the donor and the acceptor, the proximity signal can be the acceptor's emission intensity that is higher than a baseline level (e.g., about 2-fold, 5-fold, 10-fold, 20-fold, 50-fold, 100-fold higher or more) (a baseline level here is the acceptor's emission intensity when the acceptor and the donor are apart (e.g., more than 200 nm, 300 nm, 400 nm, 500 nm, 1000 nm, 2000 nm apart)).

The phrase "Factor D activity" or "activity of Factor D" refers to the enzymatic activity of Factor D to cleave Factor B.

The phrase "Factor D inhibitor" or "inhibitor of Factor D" refers to a pharmaceutical agent that reduces or blocks the activity of Factor D.

The phrase "positively correlated" is used to describe the relationship between a pair of items that both change in value in the same direction. For example, if A is "positively correlated" with B, the value of A will increase when the value of B increases, and will decrease when the value of B decreases.

The phrase "negatively correlated" is used to describe the relationship between a pair of items that both change in value in the opposite direction. For example, if A is "negatively correlated" with B, the value of A will decrease when the value of B increases, and will increase when the value of B decreases.

The term "subject" referred to throughout this application, can be, but is not limited to, a human or non-human vertebrate such as a wild, domestic or farm animal. In certain embodiments, the subject is a mammal, e.g., a human, a cow, a dog, a cat, a goat, a horse, a sheep, a pig, a rat, or a mouse. In a preferred embodiment, the subject is a human. In some embodiments, the subject is a human patient having or suspected of having a disorder associated with increased or decreased Factor D activity relative to a normal person.

The term "quench" with respect to the activity of Factor D means to terminate the enzymatic cleavage of Factor B by Factor D.

The term "quencher" refers to an agent capable of terminating the enzymatic cleavage of Factor B by Factor D.

The term "antibody" is used in the broadest sense, and specifically covers full length monoclonal antibodies, polyclonal antibodies, multi specific antibodies (e.g., bispecific antibodies) and antibody fragments so long as they exhibit the desired biological activity such as antigen-binding activity. Antibodies (Abs) and immunoglobulins (Igs) are glycoproteins having the same structural characteristics. While antibodies exhibit binding specificity to a specific target, immunoglobulins include both antibodies and other antibody-like molecules which lack target specificity. Native antibodies and immunoglobulins are usually heterotetrameric glycoproteins of about 150,000 daltons, composed of two identical light (L) chains and two identical heavy (H) chains. Each heavy chain has at one end a variable domain ($V_H$) followed by a number of constant domains. Each light chain has a variable domain at one end ($V_L$) and a constant domain at its other end. The term "Antibody" as used herein expressly encompasses antibody fragments retaining antigen-binding activity.

An "antibody fragment" refers to a molecule other than an intact antibody that comprises a portion of an intact antibody that binds the antigen to which the intact antibody binds. Examples of antibody fragments include but are not limited to Fv, Fab, Fab', Fab-SH, Fab'-SH, Fab-C, Fab'-C, Fab-C-SH, Fab'-C-SH, F(ab')2; diabodies; linear antibodies; single-chain antibody molecules (e.g., scFv); and multispecific antibodies formed from antibody fragments.

As used herein, a "Fab" refers to an antibody that comprises a heavy chain constant region that comprises the CH1 domain, or a sufficient portion of the CH1 domain to form a disulfide bond with the light chain constant region, but does not contain a CH2 domain or a CH3 domain. As used herein, a Fab may comprise one or more amino acids of the hinge region. Thus, as used herein, the term "Fab" encompasses Fab' antibodies. A Fab may comprise additional non-native amino acids, such as a C-terminal cysteine, in which case it may be referred to as a Fab-C. As discussed below, the term Fab-C also encompasses Fabs comprising native amino acids of the hinge region, including a native cysteine at the C-terminus. In some embodiments, a Fab comprises an engineered cysteine (i.e., a Fab may be a THIOMAB™).

A "Fab-C" refers to a Fab with a C-terminal cysteine, which may be a native cysteine that occurs at that residue position (such as a cysteine from the hinge region), or may be a cysteine added to the C-terminus that does not correspond to a native cysteine. Nonlimiting exemplary Fab-C heavy chain constant regions include the sequences of SEQ ID NOs: 863, 875, and 876.

A "Fab-SH" refers to a Fab with a free thiol group. In some embodiments, the free thiol group is located in the last 10 amino acids of the C-terminus of the Fab. Fab-C antibodies are typically also Fab-SH antibodies. A further nonlimiting exemplary Fab-SH heavy chain constant region having the amino acid sequence of SEQ ID NO: 865. Typically, a Fab comprising an engineered cysteine (i.e., a Fab that is a THIOMAB™) is a Fab-SH.

The term "variable region" or "variable domain" refers to the domain of an antibody heavy or light chain that is involved in binding the antibody to antigen. The variable domains of the heavy chain and light chain (VH and VL, respectively) of a native antibody generally have similar structures, with each domain comprising four conserved framework regions (FRs) and three hypervariable regions (HVRs). (See, e.g., Kindt et al. Kuby Immunology, 6th ed., W.H. Freeman and Co., page 91 (2007).) A single VH or VL domain may be sufficient to confer antigen-binding specificity. Furthermore, antibodies that bind a particular antigen may be isolated using a VH or VL domain from an antibody that binds the antigen to screen a library of complementary VL or VH domains, respectively. See, e.g., Portolano et al., J. Immunol. 150:880-887 (1993); Clarkson et al., Nature 352:624-628 (1991).

The term "variable" refers to the fact that certain portions of the variable domains differ extensively in sequence among antibodies and are used in the binding and specificity of each particular antibody for its particular antigen. However, the variability is not evenly distributed throughout the variable domains of antibodies. It is concentrated in three segments called hypervariable regions both in the light chain and the heavy chain variable domains. The more highly conserved portions of variable domains are called the framework regions (FRs). The variable domains of native heavy and light chains each comprise four FRs, largely adopting a (3-sheet configuration, connected by three hypervariable regions, which form loops connecting, and in some cases forming part of, the (3-sheet structure. The hypervariable regions in each chain are held together in close proximity by the FRs and, with the hypervariable regions from the other chain, contribute to the formation of the antigen-binding site of antibodies (see Kabat et al., Sequences of Proteins of Immunological Interest, 5th Ed. Public Health Service, National Institutes of Health, Bethesda, Md. (1991)). The constant domains are not involved directly in binding an antibody to an antigen, but exhibit various effector functions, such as participation of the antibody in antibody dependent cellular cytotoxicity (ADCC).

Papain digestion of antibodies produces two identical antigen-binding fragments, called "Fab" fragments, each with a single antigen-binding site, and a residual "Fc" fragment, whose name reflects its ability to crystallize readily. Pepsin treatment yields an F(ab')2 fragment that has two antigen-binding sites and is still capable of cross-linking antigen.

The Fab fragment also contains the constant domain of the light chain and the first constant domain (CH1) of the heavy chain. Fab' fragments differ from Fab fragments by the addition of a few residues at the carboxy terminus of the heavy chain CH1 domain including one or more cysteines from the antibody hinge region. Fab'-SH is the designation herein for Fab' in which the cysteine residue(s) of the constant domains bear at least one free thiol group. F(ab')2 antibody fragments originally were produced as pairs of Fab' fragments which have hinge cysteines between them. Other chemical couplings of antibody fragments are also known.

"Fv" is the minimum antibody fragment which contains a complete antigen-recognition and antigen-binding site. This region consists of a dimer of one heavy chain and one light chain variable domain in tight, non-covalent association. It is in this configuration that the three hypervariable regions of each variable domain interact to define an antigen-binding site on the surface of the VH-VL dimer. Collectively, the six hypervariable regions confer antigen-binding specificity to the antibody. However, even a single variable domain (or half of an Fv comprising only three hypervariable regions specific for an antigen) has the ability to recognize and bind antigen, although at a lower affinity than the entire binding site.

The term "hypervariable region" or "HVR," as used herein, refers to each of the regions of an antibody variable domain which are hypervariable in sequence and/or form structurally defined loops ("hypervariable loops"). Generally, native four-chain antibodies comprise six HVRs; three in the VH (H1, H2, H3), and three in the VL (L1, L2, L3). HVRs generally comprise amino acid residues from the hypervariable loops and/or from the "complementarity determining regions" (CDRs), the latter being of highest sequence variability and/or involved in antigen recognition. HVR-H3 is believed to play a unique role in conferring fine specificity to antibodies. See, e.g., Xu et al. (2000) Immunity 13:37-45; Johnson and Wu (2003) in Methods in Molecular Biology 248:1-25 (Lo, ed., Human Press, Totowa, N.J.). "Framework Region" or "FR" residues are those variable domain residues other than the hypervariable region residues as herein defined. An HVR region as used herein comprise any number of residues located within positions 24-36 (for L1), 46-56 (for L2), 89-97 (for L3), 26-35B (for H1), 47-65 (for H2), and 93-102 (for H3). Therefore, an HVR includes residues in positions described previously:

A) 24-34 (L1), 50-52 (L2), 91-96 (L3), 26-32 (H1), 53-55 (H2), and 96-101 (H3) (Chothia and Lesk, J. Mol. Biol. 196:901-917 (1987);

B) 24-34 of L1, 50-56 of L2, 89-97 of L3, 31-35B of H1, 50-65 of H2, and 95-102 of H3 (Kabat et al., Sequences of Proteins of Immunological Interest, 5th Ed. Public Health Service, National Institutes of Health, Bethesda, Md. (1991).

C) 30-36 (L1), 46-55 (L2), 89-96 (L3), 30-35 (H1), 47-58 (H2), 93-100a-j (H3) (MacCallum et al. J. Mol. Biol. 262: 732-745 (1996).

Hypervariable regions may comprise "extended hypervariable regions" as follows: 24-36 or 24-34 (L1), 46-56 or 50-56 (L2) and 89-97 (L3) in the VL and 26-35B (H1), 50-65, 47-65 or 49-65 (H2) and 93-102, 94-102 or 95-102 (H3) in the VH. The variable domain residues are numbered according to Kabat et al., supra for each of these definitions.

4. BRIEF DESCRIPTION OF FIGURES

5. DETAILED DESCRIPTION

Figure 1:
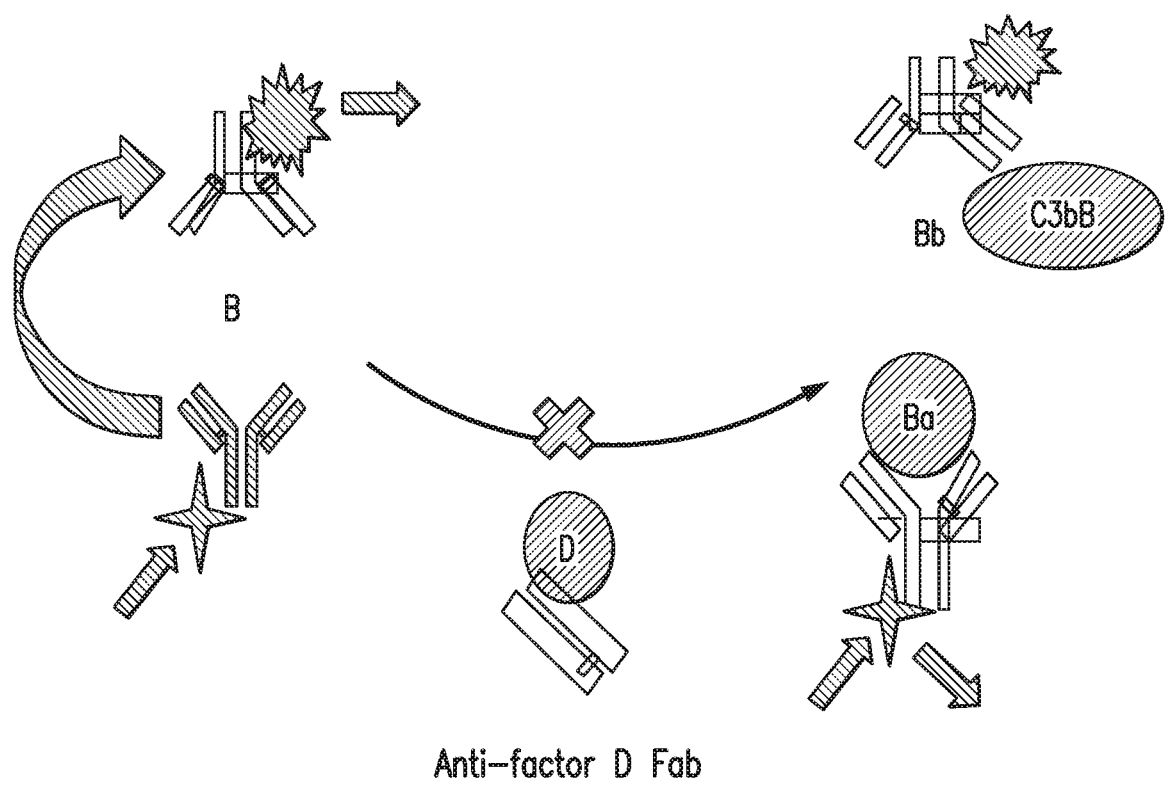
FIG. 1 depicts the assay schematic for the factor D TR-FRET (Time Resolved-FRET) assay.

The present invention provides methods of measuring Factor D activity comprising performing a proximity-based measurement assay, methods of determining the potency of Factor D inhibitors comprising performing a proximity-based measurement assay, and methods of screening for Factor D inhibitors comprising measuring Factor B cleaving using a proximity-based measurement assay. The methods are simple, fast, homogeneous and adaptable to high-throughput assays, and are based in part on the inventors' development and characterization of an assay that measures the ability of Factor D inhibitors (including lampalizumab (an anti-Factor D antibody)) to inhibit the enzymatic activity of Factor D (see Section 6). To more precisely measure Factor D activity or the potency of Factor D inhibitors, a quencher can be added to terminate the enzymatic cleavage of Factor B by Factor D before measuring. Luckily, the inventors have discovered that when both anti-Factor Ba and anti-Factor Bb are used as detection reagents, they quench the Factor D activity in the assay, therefore obviating the need to add another quencher.

5.1. Proximity-Based Measurement Assays

The proximity-based measurement assay performed according to the methods described herein can utilize any proximity-based technology known in the art for measuring the binding of a protein pair. Such assays utilize a proximity signal that is generated by an acceptor and/or a donor when the acceptor and the donor (each of which is part of, binds to, or is attached to one member of the protein pair) are brought to close proximity. Thus, the value of the proximity signal is sensitive to the distance between the acceptor and the donor. In some embodiments, the proximity signal is a signal generated by the acceptor and the donor which indicates that the acceptor and the donor (and thus the protein pair) are in proximity. In some embodiments, the proximity signal is a signal generated by the acceptor which indicates that the acceptor and the donor (and thus the protein pair) are in proximity. In some embodiments, the proximity signal is a signal generated by the donor which indicates that the acceptor and the donor (and thus the protein pair) are in proximity.

The donor/acceptor pair thus can be any pair of molecules that can generate a proximity signal whose value is sensitive to their distance. The donor and/or the acceptor may be attached to the molecule(s) of interest (i.e., member(s) of the protein pair) by a protein (e.g., an antibody or antigen-binding fragment thereof), peptide, peptide mimetic, aptamer, nucleotide (e.g., DNA, RNA, shRNA, miRNA, siRNA, antisense DNA), or any other molecule that binds to the member of the protein pair, or by direct chemical labeling. The degree of proximity between the donor and the acceptor that is required to elicit a proximity signal is dependent on the specific technology employed. Non-limiting exemplary proximity-based technologies for measuring the binding of a protein pair include Fluorescence Resonance Energy Transfer (FRET) and other FRET-based methods such as Time Resolved-FRET (TR-FRET), AlphaScreen®, AlphaLISA®, and PCR-based proximity ligation assays (see for example, Morrison, 1988, Anal Biochem 174:101-120; Ullman et al., 1994, Proc Natl Acad Sci USA 91: 5426-5430; Ullman et al., 1996, Clin Chem 42:1518-1526; Glickman et al., 2002, Journal of Biomolecular Screening 7:3-10; Bielefeld-Sevigny, 2009, Assay Drug Dev Technol 7:90-92; and Gullberg et al., 2004, Proc Natl Acad Sci USA 101: 8420-8424).

Fluorescence resonance energy transfer (FRET) is the transfer of energy between a light-sensitive donor and a light-sensitive acceptor. The donor, after being excited by a light source, may transfer energy to the acceptor. The transfer of energy leads to a reduction in the donor's fluorescence emission intensity and an increase in the acceptor's fluorescence emission intensity. The efficiency of this energy transfer is inversely proportional to the sixth power of the distance between donor and acceptor, making FRET extremely sensitive to small changes in distance, and making FRET useful in determining if the donor and the acceptor are within a certain distance of each other. When the proximity-based technology is Fluorescence Resonance Energy Transfer (FRET), the proximity signal can be the ratio between the FRET acceptor's fluorescence emission intensity and the FRET donor's fluorescence emission intensity that is higher than a baseline level (e.g., about 2-fold, 5-fold, 10-fold, 20-fold, 50-fold, 100-fold higher or more). A baseline level here is the ratio between the FRET acceptor's fluorescence emission intensity and the FRET donor's fluorescence emission intensity when the FRET acceptor and the FRET donor are apart (e.g., more than 10 nm, 20 nm, 50 nm, 100 nm, or 200 nm apart).

TR-FRET is a FRET technology that has introduced a time delay between the excitation of the donor and the fluorescence measurement to reduce or clear the non-specific interfering short-lived emission signals from the background (for example, buffers and cell lysates). The emission signals from the donor and the acceptor, however, are long-lived and will not be affected.

A pair of light-sensitive donor and acceptor molecules that interact in such a manner that FRET occurs is often referred to as a FRET pair, and is known to those skilled in the art. The mechanism of FRET-pair interaction requires that the excitation spectrum of the acceptor overlaps the emission spectrum of the donor (see, Stryer, 1978, Ann Rev Biochem 47:819-846; Cantor and Schimmel, 1980, Biophysical Chemistry Part II: Techniques for the Study of Biological Structure And Function, pages 448-455, San Francisco, Calif.: W. H. Freeman and Co.; and Selvin, 1995, Methods in Enzymology 246:300-335). The efficiency of FRET interaction is linearly proportional to this overlap (Haugland et al., 1969, Proc Natl Acad Sci USA 63:24-30). FRET pairs have been chosen on this basis.

Any of a number of FRET-pair combinations can be selected for use in the present invention (see for example, Pesce et al, eds, 1971, Fluorescence Spectroscopy, New York, N.Y.: Marcel Dekker; White et al., 1970, Fluorescence Analysis: A practical Approach, New York, N.Y.: Marcel Dekker; and Haugland, 1996, Handbook of Fluorescent Probes and Research Chemicals, 6th Ed, Eugene, Oreg.: Molecular Probes, Inc.). In general, a preferred donor is selected that has an emission spectrum that substantially overlaps the acceptor's excitation spectrum. In such applications the use of intense laser light, high-powered LED, or xenon flash lamp can serve as an effective means to excite the donor. The acceptor has a substantial overlap of its excitation spectrum with the emission spectrum of the donor. In addition, the wavelength maximum of the emission spectrum of the acceptor is preferably at least 10 nm greater than the wavelength maximum of the excitation spectrum of the donor. The emission spectrum of the acceptor is typically in the red portion of the visible spectrum, although, it is believed that acceptors having emission at longer wavelengths in the infrared region of the spectrum can be used. In some embodiments, the donor comprises Europium, the acceptor comprises Alexa 647, and the light source has a wavelength of about 340 nm.

In order to obtain FRET between the donor and the acceptor, the two have to be in spatial proximity with each other. Thus, in certain embodiments, the assay components are labeled such that the donor and the acceptor can be about 0.1 nm, 0.5 nm, 1 nm, 5 nm, or 10 nm apart from each other, or less than about 10 nm to allow FRET to occur.

AlphaScreen® and AlphaLISA® are bead-based technologies, and the assays are conducted in a microplate format. The donor and the acceptor are in the form of beads. Donor beads contain a photosensitizer, phthalocyanine, which converts ambient oxygen to an excited and reactive form of $O_2$, singlet oxygen, upon illumination at 680 nm. Singlet oxygen has a limited lifetime prior to falling back to ground state. Within its 4 µsec half-life, singlet oxygen can diffuse approximately 200 nm in solution. If an acceptor bead is within that proximity, energy is transferred from the singlet oxygen to thioxene derivatives within the acceptor bead, subsequently culminating in light production at 520 to 620 nm (AlphaScreen®) or at 615 nm (AlphaLISA®). In the absence of an acceptor bead, singlet oxygen falls to ground state and no signal is produced. When the proximity-based technology is AlphaScreen®, the proximity signal can be the acceptor's emission intensity that is higher than a baseline level (e.g., about 2-fold, 5-fold, 10-fold, 20-fold, 50-fold, 100-fold higher or more). A baseline level here is the acceptor's emission intensity when the acceptor and the donor are apart (e.g., more than 200 nm, 300 nm, 400 nm, 500 nm, 1000 nm, 2000 nm apart).

In order to obtain proximity signal from the acceptor using the AlphaScreen® or the AlphaLISA® technology, the donor and the acceptor have to be in spatial proximity with each other. Thus, in certain embodiments, the assay components are labeled such that the donor and the acceptor can be about 1 nm, 5 nm, 10 nm, 25 nm, 50 nm, 75 nm, 100 nm, 125 nm, 150 nm, 175 nm, 200 nm apart from each other, or less than about 200 nm apart from each other to allow the proximity-dependent chemical energy transfer to occur.

In PCR-based proximity ligation assays, the donor and the acceptor each contains an oligonucleotide that can be ligated. The binding of the donor and the acceptor brings in close proximity the two oligonucleotides, which are then ligated, amplified, and detected by PCR.

In certain embodiments, the proximity-based measurement assay is carried out in a microplate. In specific embodiments, the proximity-based measurement assay is conducted in a high-throughput manner. In some embodiments, the donor and/or the acceptor is in the form of beads (e.g., AlphaScreen® beads). In certain embodiments, the donor and/or the acceptor comprises streptavidin, avidin, or neutravidin (preferably streptavidin) that can bind to biotin conjugated to an assay component. In certain embodiments, the donor and/or the acceptor is directly conjugated to an assay component.

5.2. The Assay Components

The substrate for Factor D is another alternative complement pathway serine protease, Factor B. Factor C3b binds to Factor B; then, Factor D cleaves Factor B into Factor Ba and Factor Bb. Factor Bb remains bound to Factor C3b, forming the active C3 convertase, which initiates the alternative complement pathway (Volanakis, et al., 1996, Protein Science 5:553-564). Therefore, if Factor B is not cleaved by Factor D, Factor Ba and Factor Bb will be in spatial proximity with each other, Factor C3b and Factor Ba will also be in spatial proximity with each other. When Factor B is cleaved by Factor D, however, Factor Ba and Factor Bb will be apart from each other, and Factor C3b and Factor Ba will also be apart from each other.

In certain embodiments, the methods described herein rely on the distance between Factor Ba and Factor Bb, wherein one of the two is labeled with a donor, and the other is labeled with an acceptor. In such embodiments, the donor and/or the acceptor may be attached to Factor Ba or Factor Bb, respectively, by a protein (e.g., an antibody or antigen-binding fragment thereof), peptide, peptide mimetic, aptamer, nucleotide (e.g., DNA, RNA, shRNA, miRNA, siRNA, antisense DNA), or any other molecule that binds to Factor Ba or Factor Bb, or by direct chemical labeling (when the donor is attached to Factor Ba, the acceptor is attached to Factor Bb; when the donor is attached to Factor Bb, the acceptor is attached to Factor Ba).

In certain embodiments, the methods described herein rely on the distance between Factor C3b and Factor Ba, wherein one of the two is labeled with a donor, and the other is labeled with an acceptor. In such embodiments, the donor and/or the acceptor may be attached to Factor C3b or Factor Ba, respectively, by a protein (e.g., an antibody or antigen-binding fragment thereof), peptide, peptide mimetic, aptamer, nucleotide (e.g., DNA, RNA, shRNA, miRNA, siRNA, antisense DNA), or any other molecule that binds to Factor C3b or Factor Ba, or by direct chemical labeling (when the donor is attached to Factor C3b, the acceptor is attached to Factor Ba; when the donor is attached to Factor Ba, the acceptor is attached to Factor C3b).

5.3. Methods of Measuring Factor D Activity

In one aspect, provided herein are method of measuring the activity of Factor D in a sample derived from a subject, comprising performing a proximity-based measurement assay, wherein the proximity-based measurement assay measures the cleavage of Factor B. The proximity-based measurement assay can utilize any proximity-base technology known in the art for measuring the binding of a protein pair, as described in Section 5.1. The methods described in this section are useful, for example, in diagnosing or staging a human patient having or suspected of having a disorder associated with increased or decreased Factor D activity relative to a normal person.

In various embodiments, the methods of measuring the activity of Factor D comprise (a) adding to the sample an anti-Factor Ba antibody labeled with a first moiety and an anti-Factor Bb antibody labeled with a second moiety, wherein one of the moieties is a donor, and the other moiety is an acceptor, and wherein a proximity signal generated by the acceptor and/or the donor indicates that Factor Ba and Factor Bb are in proximity; and (b) measuring the value of the proximity signal from the sample; wherein the activity of Factor D in the sample is negatively correlated with the value of the proximity signal.

In certain aspects of such various embodiments, the methods of measuring the activity of Factor D further comprise: (c) adding to a control sample the anti-Factor Ba antibody labeled with the first moiety and the anti-Factor Bb antibody labeled with the second moiety; and (d) measuring the value of the proximity signal from the control sample; wherein a greater value of the proximity signal from the sample relative to the control sample (e.g., about 10%, 15%, 20%, 25%, 30%, 40%, 50%, 60%, 70%, 80%, 90% greater or more, or about 1-fold, 1.5-fold, 2-fold, 3-fold, 4-fold, 5-fold, 6-fold, 7-fold, 8-fold, 9-fold, 10-fold, 15-fold, 20-fold, 30-fold, 40-fold, 50-fold greater or more) indicates a lower activity of Factor D in the sample relative to the control sample.

When the proximity signal generated by the donor and/or the acceptor is based on energy transfer between the donor and the acceptor upon light activation, in various embodiments, the methods of measuring the activity of Factor D comprise: (A) adding to the sample an anti-Factor Ba antibody labeled with a first moiety and an anti-Factor Bb antibody labeled with a second moiety, wherein one of the moieties is a donor, and the other moiety is an acceptor; (B) providing a light source to excite the donor in the sample; and (C) measuring the donor fluorescence emission intensity from the sample, and/or the acceptor fluorescence emission intensity from the sample; wherein the activity of Factor D in the sample is positively correlated with the donor fluorescence emission intensity from the sample, and/or is negatively correlated with the acceptor fluorescence emission intensity from the sample. In certain embodiments, the step of (C) is performed after a period of time of the step of (B) that results in a decrease in interfering short-lived background signals. In specific embodiments, the methods of measuring the activity of Factor D further comprise: (D) adding to a control sample the anti-Factor Ba antibody labeled with the first moiety and the anti-Factor Bb antibody labeled with the second moiety; (E) providing the same light source to excite the donor in the control sample; and (F) measuring the donor fluorescence emission intensity from the control sample, and/or the acceptor fluorescence emission intensity from the control sample; wherein a lower donor fluorescence emission intensity from the sample relative to the control sample, and/or a higher acceptor fluorescence emission intensity from the sample relative to the control sample, indicates a lower activity of Factor D in the sample relative to the control sample. In certain embodiments, the step of (C) is performed after a period of time of the step of (B) that results in a decrease in interfering short-lived background signals, and the step of (F) is performed after the same period of time of the step of (E).

In certain embodiments, the anti-Factor Ba antibody and the anti-Factor Bb antibody used in the methods of measuring the activity of Factor D quench the activity of Factor D. In such embodiments, the need to add another quencher is obviated. In certain embodiments, the methods of measuring the activity of Factor D further comprise a step of quenching the activity of Factor D in the sample by providing an excessive amount of a quencher to the sample before the step of (a). When a control sample is used, in certain embodiments, the methods of measuring the activity of Factor D further comprise a step of quenching the activity of Factor D in the sample by providing an excessive amount of a quencher to the sample before the step of (a), and a step of quenching the activity of Factor D in the control sample by providing an excessive amount of the quencher to the control sample before the step of (c). In specific embodiments, the quencher is a Factor D inhibitor (for example, an anti-Factor D antibody or an excess amount of EDTA).

In certain embodiments, the anti-Factor Ba antibody is biotinylated, and the first moiety comprises streptavidin, avidin, or neutravidin. In some embodiments, the anti-Factor Ba antibody is biotinylated, and the first moiety comprises streptavidin. In certain embodiments, the anti-Factor Bb antibody is biotinylated, and the second moiety comprises streptavidin, avidin, or neutravidin. In some embodiments, the anti-Factor Bb antibody is biotinylated, and the second moiety comprises streptavidin.

In other various embodiments, the methods of measuring the activity of Factor D comprise (a) adding to the sample an anti-Factor C3b antibody labeled with a first moiety and an anti-Factor Ba antibody labeled with a second moiety, wherein one of the moieties is a donor, and the other moiety is an acceptor, and wherein a proximity signal generated by the acceptor and/or the donor indicates that Factor C3b and Factor Ba are in proximity; and (b) measuring the value of the proximity signal from the sample; wherein the activity of Factor D in the sample is negatively correlated with the value of the proximity signal.

In certain aspects of such other various embodiments, the methods of measuring the activity of Factor D further comprise: (c) adding to a control sample the anti-Factor C3b antibody labeled with the first moiety and the anti-Factor Ba antibody labeled with the second moiety; and (d) measuring the value of the proximity signal from the control sample; wherein a greater value of the proximity signal from the sample relative to the control sample (e.g., about 10%, 15%, 20%, 25%, 30%, 40%, 50%, 60%, 70%, 80%, 90% greater or more, or about 1-fold, 1.5-fold, 2-fold, 3-fold, 4-fold, 5-fold, 6-fold, 7-fold, 8-fold, 9-fold, 10-fold, 15-fold, 20-fold, 30-fold, 40-fold, 50-fold greater or more) indicates a lower activity of Factor D in the sample relative to the control sample.

When the proximity signal generated by the donor and/or the acceptor is based on energy transfer between the donor and the acceptor upon light activation, in various embodiments, the methods of measuring the activity of Factor D comprise: (A) adding to the sample an anti-Factor C3b antibody labeled with a first moiety and an anti-Factor Ba antibody labeled with a second moiety, wherein one of the moieties is a donor, and the other moiety is an acceptor; (B) providing a light source to excite the donor in the sample; and (C) measuring the donor fluorescence emission intensity from the sample, and/or the acceptor fluorescence emission intensity from the sample; wherein the activity of Factor D in the sample is positively correlated with the donor fluorescence emission intensity from the sample, and/or is negatively correlated with the acceptor fluorescence emission intensity from the sample. In certain embodiments, the step of (C) is performed after a period of time of the step of (B) that results in a decrease in interfering short-lived background signals. In specific embodiments, the methods of measuring the activity of Factor D further comprise: (D) adding to a control sample the anti-Factor C3b antibody labeled with the first moiety and the anti-Factor Ba antibody labeled with the second moiety; (E) providing the same light source to excite the donor in the control sample; and (F) measuring the donor fluorescence emission intensity from the control sample, and/or the acceptor fluorescence emission intensity from the control sample; wherein a lower donor fluorescence emission intensity from the sample relative to the control sample, and/or a higher FRET acceptor fluorescence emission intensity from the sample relative to the control sample, indicates a lower activity of Factor D in the sample relative to the control sample. In certain embodiments, the step of (C) is performed after a period of time of the step of (B) that results in a decrease in interfering short-lived background signals, and the step of (F) is performed after the same period of time of the step of (E).

In certain embodiments wherein anti-Factor C3b antibody and anti-Factor Ba antibody are used, the anti-Factor C3b antibody is biotinylated, and the first moiety comprises streptavidin, avidin, or neutravidin. In some embodiments, the anti-Factor C3b antibody is biotinylated, and the first moiety comprises streptavidin. In certain embodiments, the anti-Factor Ba antibody is biotinylated, and the second moiety comprises streptavidin, avidin, or neutravidin. In some embodiments, the anti-Factor Ba antibody is biotinylated, and the second moiety comprises streptavidin.

In certain embodiments wherein anti-Factor C3b antibody and anti-Factor Ba antibody are used, the anti-Factor C3b antibody and the anti-Factor Ba antibody used in the methods of measuring the activity of Factor D quench the activity of Factor D. In such embodiments, the need to add another quencher is obviated. In certain embodiments wherein anti-Factor C3b antibody and anti-Factor Ba antibody are used, the methods of measuring the activity of Factor D further comprise a step of quenching the activity of Factor D in the sample by providing an excessive amount of a quencher to the sample before the step of (a). When a control sample is used, in certain embodiments, the methods of measuring the activity of Factor D further comprise a step of quenching the activity of Factor D in the sample by providing an excessive amount of a quencher to the sample before the step of (a), and a step of quenching the activity of Factor D in the control sample by providing an excessive amount of the quencher to the control sample before the step of (c). In specific embodiments, the quencher is a Factor D inhibitor (for example, an anti-Factor D antibody or an excess amount of EDTA).

The sample can comprise a tissue, a population of cells directed isolated from the subject, a population of cultured cells derived from the subject, or a preparation from the tissue, the population of cells or the population of cultured cells that allows the activity of Factor D to be measured. When a control sample is used, the control sample is preferably in the same format as the sample. The control sample can be, but is not limited to, a sample with known Factor D activity or a sample with no Factor D activity. In specific embodiments, more than one control sample is used in the methods described herein. In certain embodiments, a standard curve has been generated for quantifying the activity of Factor D in samples without the need to measure a control sample.

The donor/acceptor pair can be any known in the art, or as described in Section 5.1.

The subject referred to in the methods described herein, can be, but is not limited to, a human or non-human vertebrate such as a wild, domestic or farm animal. In certain embodiments, the subject is a mammal, e.g., a human, a cow, a dog, a cat, a goat, a horse, a sheep, a pig, a rat, or a mouse. In a preferred embodiment, the subject is a human. In some embodiments, the subject is a human patient having or suspected of having a disorder associated with increased or decreased Factor D activity relative to a normal person, such as age-related macular degeneration (AMD). In some embodiments, the subject is a human patient having or suspected of having a disorder associated with excessive or uncontrolled complement activation. They include: complement activation during cardiopulmonary bypass operations; complement activation due to ischemia-reperfusion following acute myocardial infarction, aneurysm, stroke, hemorrhagic shock, crush injury, multiple organ failure, hypobolemic shock and intestinal ischemia. These disorders associated with excessive or uncontrolled complement activation can also include disease or condition is an inflammatory condition such as severe burns, endotoxemia, septic shock, adult respiratory distress syndrome, hemodialysis; anaphylactic shock, severe asthma, angioedema, Crohn's disease, sickle cell anemia, poststreptococcal glomerulonephritis and pancreatitis. The disorder may be the result of an adverse drug reaction, drug allergy, IL-2 induced vascular leakage syndrome or radiographic contrast media allergy. It also includes autoimmune disease such as systemic lupus erythematosus, myasthenia gravis, rheumatoid arthritis, Alzheimer's disease and multiple sclerosis. Complement activation is also associated with transplant rejection. Complement activation is also associated with ocular diseases (all ocular conditions and diseases the pathology of which involve complement, including the classical and the alternative pathway of complement), such as, for example, without limitation, macular degenerative disease, such as all stages of age-related macular degeneration (AMD), including dry and wet (non-exudative and exudative) forms, diabetic retinopathy and other ischemia-related retinopathies, choroidal neovascularization (CNV), uveitis, diabetic macular edema, pathological myopia, von Hippel-Lindau disease, histoplasmosis of the eye, Central Retinal Vein Occlusion (CRVO), corneal neovascularization, and retinal neovascularization. In one example, complement-associated eye conditions include age-related macular degeneration (AMD), including non-exudative (e.g intermediate dry AMD or geographic atrophy (GA)) and exudative (e.g. wet AMD (choroidal neovascularization (CNV)) AMD, diabetic retinopathy (DR), endophthalmitis and uveitis. In a further example, nonexudative AMD may include the presence of hard drusen, soft drusen, geographic atrophy and/or pigment clumping. In another example, complement-associated eye conditions include age-related macular degeneration (AMD), including early AMD (e.g. includes multiple small to one or more non-extensive medium sized drusen), intermediate AMD (e.g. includes extensive medium drusen to one or more large drusen) and advanced AMD (e.g. includes geographic atrophy or advanced wet AMD (CNV). In a further example, intermediate dry AMD may include large confluent drusen. In a further example, geographic atrophy may include photoreceptor and/or Retinal Pigmented Epithelial (RPE) loss. In a further example, the area of geographic atrophy may be small or large and/or may be in the macula area or in the peripheral retina. In one example, the complement-associated eye condition is intermediate dry AMD. In one example, the complement-associated eye condition is geographic atrophy. In one example, the complement-associated eye condition is wet AMD (choroidal neovascularization (CNV)).

In the methods of measuring the activity of Factor B described above, the anti-Factor Ba, anti-Factor Bb, and/or anti-Factor C3b may be replaced by a peptide, a non-antibody protein, a peptide memetic, an aptamer, a nucleotide (e.g., DNA, RNA, shRNA, miRNA, siRNA, antisense DNA), or any other molecule that binds to Factor Ba, Factor Bb, or anti-Factor C3b, respectively. Alternatively, the Factor Ba, Factor Bb, and/or Factor C3b may be directed attached to the donor or acceptor (as the case may be) by direct chemical labeling.

In specific embodiments of the methods of measuring the activity of Factor D described herein, the Factor B is a recombinantly expressed Factor B. In specific embodiments of the methods of measuring the activity of Factor D described herein, the Factor B is endogenously expressed Factor B purified from a sample derived from a subject.

The Factor D can be recombinantly expressed or endogenously expressed. In some embodiments, the Factor D is purified from the sample before the measuring of its activity.

The term "sample" referred to in the methods described herein, can be, but is not limited to, a blood sample or a serum sample.

5.4. Methods of Determining the Potency of Factor D Inhibitor

In another aspect, provided herein are methods of determining the potency of a Factor D inhibitor in inhibiting Factor D activity, comprising performing a proximity-based measurement assay, wherein the proximity-based measurement assay measures the cleavage of Factor B. The proximity-based measurement assay can utilize any proximity-based technology known in the art for measuring the binding of a protein pair, as described in Section 5.1. The methods described in this section are useful, for example, in assessing the quality of anti-Factor D therapeutics for quality control in batch manufacturing, and in testing the potency of selected anti-Factor D therapeutic leads.

In various embodiments, the methods of determining the potency of a Factor D inhibitor comprise: (a) mixing a Factor D inhibitor candidate with Factor D, Factor B and Factor C3b in a test reaction mix; (b) incubating the test reaction mix; (c) adding to the test reaction mix an anti-Factor Ba antibody labeled with a first moiety and an anti-Factor Bb antibody labeled with a second moiety after the step of (b), wherein one of the moieties is a donor, and the other is an acceptor, and wherein a proximity signal generated by the acceptor and/or the donor indicates that Factor Ba and Factor Bb are in proximity; and (d) measuring the value of the proximity signal from the test reaction mix; wherein the potency of the Factor D inhibitor is positively correlated with the value of the proximity signal.

In certain aspects of such various embodiments, the methods of determining the potency of a Factor D inhibitor further comprise: (e) mixing a control reaction mix; (f) incubating the control reaction mix; (g) adding to the control reaction mix the anti-Factor Ba antibody labeled with the first moiety and the anti-Factor Bb antibody labeled with the second moiety after the step of (f); and (h) measuring the value of the proximity signal from the control test reaction mix; wherein a greater value of the proximity signal from the test reaction mix relative to the control reaction mix (e.g., about 10%, 15%, 20%, 25%, 30%, 40%, 50%, 60%, 70%, 80%, 90% greater or more, or about 1-fold, 1.5-fold, 2-fold, 3-fold, 4-fold, 5-fold, 6-fold, 7-fold, 8-fold, 9-fold, 10-fold, 15-fold, 20-fold, 30-fold, 40-fold, 50-fold greater or more) indicates a greater inhibition of Factor D activity by the Factor D inhibitor in the test reaction mix relative to the control reaction mix.

When the proximity signal generated by the donor and/or the acceptor is based on energy transfer between the donor and the acceptor upon light activation, in various embodiments, the methods of determining the potency of a Factor D inhibitor comprise: (A) mixing the Factor D inhibitor with Factor D, Factor B and Factor C3b in a test reaction mix; (B) incubating the test reaction mix; (C) adding to the test reaction mix an anti-Factor Ba antibody labeled with a first moiety and an anti-Factor Bb antibody labeled with a second moiety after the step of (B), wherein one of the moieties is a donor, and the other moiety is an acceptor; (D) providing a light source to excite the donor in the test reaction mix; and (E) measuring the donor fluorescence emission intensity from the test reaction mix, and/or the acceptor fluorescence emission intensity from the test reaction mix; wherein the potency of the Factor D inhibitor is negatively correlated with the donor fluorescence emission intensity from the test reaction mix, and/or is positively correlated with the acceptor fluorescence emission intensity from the test reaction mix. In specific embodiments, the step of (B) is conducted for about 15 min, 30 min, 45 min, 60 min, 75 min, or 90 min. In some embodiments, the step of (B) is conducted for about 45 min. In certain embodiments, the step of (E) is performed after a period of time of the step of (D) that results in a decrease in interfering short-lived background signals. In specific embodiments, the methods of determining the potency of a Factor D inhibitor further comprise: (F) mixing a control reaction mix; (G) incubating the control reaction mix; (H) adding to the control reaction mix the anti-Factor Ba antibody labeled with the first moiety and the anti-Factor Bb antibody labeled with the second moiety after the step of (G); (I) providing the same light source to excite the donor in the control reaction mix; and (J) measuring the donor fluorescence emission intensity from the control reaction mix, and/or the acceptor fluorescence emission intensity from the control reaction mix; wherein a lower donor fluorescence emission intensity from the test reaction mix relative to the control reaction mix, and/or a higher acceptor fluorescence emission intensity from the test reaction mix relative to the control reaction mix, indicates a greater inhibition of Factor D activity by the Factor D inhibitor in the test reaction mix relative to the control reaction mix. In specific embodiments, the steps of (B) and (G) are conducted for about 15 min, 30 min, 45 min, 60 min, 75 min, or 90 min. In some embodiments, the steps of (B) and (G) are conducted for about 45 min. In certain embodiments, the step of (E) is performed after a period of time of the step of (D) that results in a decrease in interfering short-lived background signals, and the step of (J) is performed after the same period of time of the step of (I).

In certain embodiments, the anti-Factor Ba antibody and the anti-Factor Bb antibody used in the method of determining the potency of a Factor D inhibitor quench the activity of Factor D. In such embodiments, the need to add another quencher specifically is obviated. In certain embodiments, the method of determining the potency of a Factor D inhibitor further comprise a step of quenching the activity of Factor D in the sample by providing an excessive amount of a quencher to the sample before the step of (c). When a control sample is used, in certain embodiments, the methods of measuring the activity of Factor D further comprise a step of quenching the activity of Factor D in the sample by providing an excessive amount of a quencher to the sample before the step of (c), and a step of quenching the activity of Factor D in the control sample by providing an excessive amount of the quencher to the control sample before the step of (g). In specific embodiments, the quencher is a Factor D inhibitor (for example, an anti-Factor D antibody or an excess amount of EDTA).

In certain embodiments, the anti-Factor Ba antibody is biotinylated, and the first moiety comprises streptavidin, avidin, or neutravidin. In some embodiments, the anti-Factor Ba antibody is biotinylated, and the first moiety comprises streptavidin. In certain embodiments, the anti-Factor Bb antibody is biotinylated, and the second moiety comprises streptavidin, avidin, or neutravidin. In some embodiments, the anti-Factor Bb antibody is biotinylated, and the second moiety comprises streptavidin.

In other various embodiments, the methods of determining the potency of a Factor D inhibitor comprise: (a) mixing a Factor D inhibitor candidate with Factor D, Factor B and Factor C3b in a test reaction mix; (b) incubating the test reaction mix; (c) adding to the test reaction mix an anti-Factor C3b antibody labeled with a first moiety and an anti-Factor Ba antibody labeled with a second moiety after the step of (b), wherein one of the moieties is a donor, and the other is an acceptor, and wherein a proximity signal generated by the acceptor and/or the donor indicates that Factor C3b and Factor Ba are in proximity; and (d) measuring the value of the proximity signal from the test reaction mix; wherein the potency of the Factor D inhibitor is positively correlated with the value of the proximity signal.

In certain aspects of such other various embodiments, the methods of determining the potency of a Factor D inhibitor further comprise: (e) mixing a control reaction mix; (f) incubating the control reaction mix; (g) adding to the control reaction mix the anti-Factor C3b antibody labeled with the first moiety and the anti-Factor Ba antibody labeled with the second moiety after the step of (f); and (h) measuring the value of the proximity signal from the control test reaction mix; wherein a greater value of the proximity signal from the test reaction mix relative to the control reaction mix (e.g., about 10%, 15%, 20%, 25%, 30%, 40%, 50%, 60%, 70%, 80%, 90% greater or more, or about 1-fold, 1.5-fold, 2-fold, 3-fold, 4-fold, 5-fold, 6-fold, 7-fold, 8-fold, 9-fold, 10-fold, 15-fold, 20-fold, 30-fold, 40-fold, 50-fold greater or more) indicates a greater inhibition of Factor D activity by the Factor D inhibitor in the test reaction mix relative to the control reaction mix.

When the proximity signal generated by the donor and/or the acceptor is based on energy transfer between the donor and the acceptor upon light activation, in various embodiments, the methods of determining the potency of a Factor D inhibitor comprise: (A) mixing the Factor D inhibitor with Factor D, Factor B and Factor C3b in a test reaction mix; (B) incubating the test reaction mix; (C) adding to the test reaction mix an anti-Factor C3b antibody labeled with a first moiety and an anti-Factor Ba antibody labeled with a second moiety after the step of (B), wherein one of the moieties is a donor, and the other moiety is an acceptor; (D) providing a light source to excite the donor in the test reaction mix; and (E) measuring the donor fluorescence emission intensity from the test reaction mix, and/or the acceptor fluorescence emission intensity from the test reaction mix; wherein the potency of the Factor D inhibitor is negatively correlated with the donor fluorescence emission intensity from the test reaction mix, and/or is positively correlated with the acceptor fluorescence emission intensity from the test reaction mix. In specific embodiments, the step of (B) is conducted for about 15 min, 30 min, 45 min, 60 min, 75 min, or 90 min. In some embodiments, the step of (B) is conducted for about 45 min. In certain embodiments, the step of (E) is performed after a period of time of the step of (D) that results in a decrease in interfering short-lived background signals. In specific embodiments, the methods of determining the potency of a Factor D inhibitor further comprise: (F) mixing a control reaction mix; (G) incubating the control reaction mix; (H) adding to the control reaction mix the anti-Factor C3b antibody labeled with the first moiety and the anti-Factor Ba antibody labeled with the second moiety after the step of (G); (I) providing said light source to excite the donor in the control reaction mix; and (J) measuring the donor fluorescence emission intensity from the control reaction mix, and/or the acceptor fluorescence emission intensity from the control reaction mix; wherein a lower donor fluorescence emission intensity from the test reaction mix relative to the control reaction mix, and/or a higher acceptor fluorescence emission intensity from the test reaction mix relative to the control reaction mix, indicates a greater inhibition of Factor D activity by the Factor D inhibitor in the test reaction mix relative to the control reaction mix. In specific embodiments, the steps of (B) and (G) are conducted for about 15 min, 30 min, 45 min, 60 min, 75 min, or 90 min. In some embodiments, the steps of (B) and (G) are conducted for about 45 min. In certain embodiments, the step of (E) is performed after a period of time of the step of (D) that results in a decrease in interfering short-lived background signals, and the step of (J) is performed after the same period of time of the step of (I).

In certain embodiments wherein anti-Factor C3b antibody and anti-Factor Ba antibody are used, the anti-Factor C3b antibody is biotinylated, and the first moiety comprises streptavidin, avidin, or neutravidin. In some embodiments, the anti-Factor C3b antibody is biotinylated, and the first moiety comprises streptavidin. In certain embodiments, the anti-Factor Ba antibody is biotinylated, and the second moiety comprises streptavidin, avidin, or neutravidin. In some embodiments, the anti-Factor Ba antibody is biotinylated, and the second moiety comprises streptavidin.

In certain embodiments wherein anti-Factor C3b antibody and anti-Factor Ba antibody are used, the anti-Factor C3b antibody and the anti-Factor Ba antibody used in the method of determining the potency of a Factor D inhibitor quench the activity of Factor D. In such embodiments, the need to add another quencher specifically is obviated. In certain embodiments wherein anti-Factor C3b antibody and anti-Factor Ba antibody are used, the method of determining the potency of a Factor D inhibitor further comprise a step of quenching the activity of Factor D in the sample by providing an excessive amount of a quencher to the sample before the step of (c). When a control sample is used, in certain embodiments, the method of determining the potency of a Factor D inhibitor further comprise a step of quenching the activity of Factor D in the sample by providing an excessive amount of a quencher to the sample before the step of (c), and a step of quenching the activity of Factor D in the control sample by providing an excessive amount of the quencher to the control sample before the step of (g). In specific embodiments, the quencher is a Factor D inhibitor (for example, an anti-Factor D antibody or an excess amount of EDTA).

The control reaction mix can comprise, for example, a different Factor D inhibitor with known potency (e.g., 100% potency) or no Factor D inhibitor, but contains everything else essentially the same as the test reaction mix. A quencher as described above can be used as a different Factor D inhibitor in the control reaction mix. In specific embodiments, more than one control reaction mix is used in the methods described herein. In certain embodiments, a standard curve has been generated for quantifying the potency of Factor D inhibitors in samples without the need to measure a control reaction mix.

The donor/acceptor pair can be any known in the art, or as described in Section 5.1.

The Factor D inhibitor can be any pharmaceutical agent that reduces or blocks the activity of Factor D.

In specific embodiments, the Factor D inhibitor is an antibody or an antigen-binding fragment thereof, for example, an antibody or an antigen-binding fragment thereof that binds to Factor D (see for example, International Patent Application Publication No. WO 1999/042133, International Patent Application Publication No. WO 2007/056227, International Patent Application Publication No. WO 2008/055206, International Patent Application Publication No. WO 2008/147883, and International Patent Application Publication No. WO 2009/134711, the disclosures of which are hereby incorporated by reference herein in their entireties). In some embodiments, the antibody is a murine antibody. In other embodiments, the antibody is a humanized antibody. In specific embodiments, the antibody is a bispecific antibody (e.g., a bispecific antibody that binds to Factor D and HTRA1). In some embodiments, the antibody is lampalizumab (see, International Patent Application Publication No. WO 2009/134711, the disclosure of which is hereby incorporated by reference herein in its entirety).

In some embodiments, the antibody comprises one, two, three, four, five or six of the following HVRs: (i) an HVR-H1 comprising the amino acid sequence of SEQ ID NO: 1; (ii) an HVR-H2 comprising the amino acid sequence of SEQ ID NO: 2, SEQ ID NO: 3, or SEQ ID NO: 4; (iii) an HVR-H3 comprising the amino acid sequence of SEQ ID NO: 5, SEQ ID NO:6, SEQ ID NO: 7, or SEQ ID NO: 8; (iv) an HVR-L1 comprising the amino acid sequence of SEQ ID NO: 9, SEQ ID NO: 10, SEQ ID NO: 11, SEQ ID NO: 12, SEQ ID NO: 13, SEQ ID NO: 14, SEQ ID NO: 15, SEQ ID NO: 16, or SEQ ID NO: 17; (v) an HVR-L2 comprising the amino acid sequence of SEQ ID NO: 18; or (vi) an HVR-L3 comprising the amino acid sequence of SEQ ID NO: 19 or SEQ ID NO: 20 (see Table 1).

In some embodiments, the antibody comprises one, two, three, four, five or six of the following HVRs: (i) an HVR-H1 comprising the amino acid sequence of SEQ ID NO: 85; (ii) an HVR-H2 comprising the amino acid sequence of SEQ ID NO: 86, SEQ ID NO: 87, SEQ ID NO: 88, SEQ ID NO: 89, SEQ ID NO: 90, SEQ ID NO: 91, SEQ ID NO: 92, SEQ ID NO: 93, or SEQ ID NO: 94; (iii) an HVR-H3 comprising the amino acid sequence of SEQ ID NO: 95; (iv) an HVR-L1 comprising the amino acid sequence of SEQ ID NO: 96; (v) an HVR-L2 comprising the amino acid sequence of SEQ ID NO: 97, SEQ ID NO: 98, or SEQ ID NO: 99; or (vi) an HVR-L3 comprising the amino acid sequence of SEQ ID NO: 100 or SEQ ID NO: 101 (see Table 2).

TABLE 1

HVR amino acid sequences (in accordance with Kabat + Chothia HVR definitions) of anti-Factor D antibodies

| Antibody | HVR-H1 | HVR-H2 | HVR-H3 | HVR-L1 | HVR-L2 | HVR-L3 |
|---|---|---|---|---|---|---|
| AFD WT | GYTFTNYGMN SEQ ID NO: 1 | WINTYTGET TYADDFKG SEQ ID NO: 2 | EGGVNN SEQ ID NO: 5 | ITSTDIDDDMN SEQ ID NO: 9 | GGNTLRP SEQ ID NO: 18 | LQSDSLPYT SEQ ID NO: 19 |
| AFD.v1 | GYTFTNYGMN SEQ ID NO: 1 | WINTYTGET TYADDFKG SEQ ID NO: 2 | EGGVNN SEQ ID NO: 5 | ITSTSIDDDMN SEQ ID NO: 10 | GGNTLRP SEQ ID NO: 18 | LQSDSLPYT SEQ ID NO: 19 |
| AFD.v2 | GYTFTNYGMN SEQ ID NO: 1 | WINTYTGET TYADDFKG SEQ ID NO: 2 | EGGVNN SEQ ID NO: 5 | ITSTDIEDDMN SEQ ID NO: 11 | GGNTLRP SEQ ID NO: 18 | LQSDSLPYT SEQ ID NO: 19 |
| AFD.v3 | GYTFTNYGMN SEQ ID NO: 1 | WINTYTGET TYADDFKG SEQ ID NO: 2 | EGGVNN SEQ ID NO: 5 | ITSTDIDSDMN SEQ ID NO: 12 | GGNTLRP SEQ ID NO: 18 | LQSDSLPYT SEQ ID NO: 19 |
| AFD.v4 | GYTFTNYGMN SEQ ID NO: 1 | WINTYTGET TYADDFKG SEQ ID NO: 2 | EGGVNN SEQ ID NO: 5 | ITSTDIDDSMN SEQ ID NO: 13 | GGNTLRP SEQ ID NO: 18 | LQSDSLPYT SEQ ID NO: 19 |
| AFD.v5 | GYTFTNYGMN SEQ ID NO: 1 | WINTYTGET TYADDFKG SEQ ID NO: 2 | EGGVNN SEQ ID NO: 5 | ITSTSIDSSMN SEQ ID NO: 14 | GGNTLRP SEQ ID NO: 18 | LQSDSLPYT SEQ ID NO: 19 |
| AFD.v6 | GYTFTNYGMN SEQ ID NO: 1 | WINTYTGET TYAEDFKG SEQ ID NO: 3 | EGGVNN SEQ ID NO: 5 | ITSTDIESDMN SEQ ID NO: 15 | GGNTLRP SEQ ID NO: 18 | LQSDSLPYT SEQ ID NO: 19 |
| AFD.v7 | GYTFTNYGMN SEQ ID NO: 1 | WINTYTGET TYAEDFKG SEQ ID NO: 3 | EGGVNN SEQ ID NO: 5 | ITSTDIESDMN SEQ ID NO: 15 | GGNTLRP SEQ ID NO: 18 | LQSESLPYT SEQ ID NO: 20 |
| AFD.v8 | GYTFTNYGMN SEQ ID NO: 1 | WINTYTGET TYAEDFKG SEQ ID NO: 3 | EGGVNN SEQ ID NO: 5 | ITSTSIESDMN SEQ ID NO: 16 | GGNTLRP SEQ ID NO: 18 | LQSDSLPYT SEQ ID NO: 19 |
| AFD.v9 | GYTFTNYGMN SEQ ID NO: 1 | WINTYTGET TYAEDFKG SEQ ID NO: 3 | EGGVNN SEQ ID NO: 5 | ITSTSIESDMS SEQ ID NO: 17 | GGNTLRP SEQ ID NO: 18 | LQSDSLPYT SEQ ID NO: 19 |
| AFD.v10 | GYTFTNYGMN SEQ ID NO: 1 | WINTYTGET TYAEDFKG SEQ ID NO: 3 | EGGVNN SEQ ID NO: 5 | ITSTSIESDMN SEQ ID NO: 16 | GGNTLRP SEQ ID NO: 18 | LQSESLPYT SEQ ID NO: 20 |
| AFD.v11 | GYTFTNYGMN SEQ ID NO: 1 | WISTYTGET TYAEDFKG SEQ ID NO: 4 | EGGVNN SEQ ID NO: 5 | ITSTSIESDMN SEQ ID NO: 16 | GGNTLRP SEQ ID NO: 18 | LQSDSLPYT SEQ ID NO: 19 |
| AFD.v12 | GYTFTNYGMN SEQ ID NO: 1 | WINTYTGET TYAEDFKG SEQ ID NO: 3 | EGGVDN SEQ ID NO: 6 | ITSTSIESDMN SEQ ID NO: 16 | GGNTLRP SEQ ID NO: 18 | LQSDSLPYT SEQ ID NO: 19 |
| AFD.v13 | GYTFTNYGMN SEQ ID NO: 1 | WINTYTGET TYAEDFKG SEQ ID NO: 3 | EGGVQN SEQ ID NO: 7 | ITSTSIESDMN SEQ ID NO: 16 | GGNTLRP SEQ ID NO: 18 | LQSDSLPYT SEQ ID NO: 19 |
| AFD.v14 | GYTFTNYGMN SEQ ID NO: 1 | WINTYTGET TYAEDFKG SEQ ID NO: 3 | EGGVSN SEQ ID NO: 8 | ITSTSIESDMN SEQ ID NO: 16 | GGNTLRP SEQ ID NO: 18 | LQSDSLPYT SEQ ID NO: 19 |
| AFD.v15 | GYTFTNYGMN SEQ ID NO: 1 | WINTYTGET TYAEDFKG SEQ ID NO: 3 | EGGVSN SEQ ID NO: 8 | ITSTSIESDMN SEQ ID NO: 16 | GGNTLRP SEQ ID NO: 18 | LQSDSLPYT SEQ ID NO: 20 |

TABLE 2

HVR amino acid sequences (in accordance with Kabat HVR definitions) of additional anti-Factor D antibodies

| Antibody | HVR-H1 | HVR-H2 | HVR-H3 | HVR-L1 | HVR-L2 | HVR-L3 |
|---|---|---|---|---|---|---|
| murine AFD | SYYMY SEQ ID NO: 85 | EINPTNGGTN FNEKFKS SEQ ID NO: 86 | EGGFAY SEQ ID NO: 95 | KASQNVDTDVA SEQ ID NO: 96 | SASSRYS SEQ ID NO: 97 | QQYNNYPLT SEQ ID NO: 100 |
| huAFD.v2.0 | SYYMY SEQ ID NO: 85 | EINPTSGGTN FNEKFKS SEQ ID NO: 87 | EGGFAY SEQ ID NO: 95 | KASQNVDTDVA SEQ ID NO: 96 | SASSRYS SEQ ID NO: 97 | QQYNNYPLT SEQ ID NO: 100 |
| huAFD.v2.1 | SYYMY SEQ ID NO: 85 | EINPTSGGTN FNEKFKS SEQ ID NO: 87 | EGGFAY SEQ ID NO: 95 | KASQNVDTDVA SEQ ID NO: 96 | SASSRYS SEQ ID NO: 97 | QQYNNYPLT SEQ ID NO: 100 |
| huAFD.v2.3 | SYYMY SEQ ID NO: 85 | EINPYSGUIN FNEKFKS SEQ ID NO: 88 | EGGFAY SEQ ID NO: 95 | KASQNVDTDVA SEQ ID NO: 96 | SASSRYS SEQ ID NO: 97 | QQYNNYPLT SEQ ID NO: 100 |
| huAFD.v1 | SYYMY SEQ ID NO: 85 | EINPTNGGTN FNEKFKS SEQ ID NO: 86 | EGGFAY SEQ ID NO: 95 | KASQNVDTDVA SEQ ID NO: 96 | SASSRYS SEQ ID NO: 97 | QQYNNYPLT SEQ ID NO: 100 |
| huAFD.v1.1 | SYYMY SEQ ID NO: 85 | EINPTQGGTN FNEKFKS SEQ ID NO: 89 | EGGFAY SEQ ID NO: 95 | KASQNVDTDVA SEQ ID NO: 96 | SASSRYS SEQ ID NO: 97 | QQYNNYPLT SEQ ID NO: 100 |
| huAFD.v2.2 | SYYMY SEQ ID NO: 85 | EINPTSGDTN FNEKFKS SEQ ID NO: 90 | EGGFAY SEQ ID NO: 95 | KASQNVDTDVA SEQ ID NO: 96 | SASSRYS SEQ ID NO: 97 | QQYNNYPLT SEQ ID NO: 100 |
| huAFD.v2.4 | SYYMY SEQ ID NO: 85 | EINPTSGETN FNEKFKS SEQ ID NO: 91 | EGGFAY SEQ ID NO: 95 | KASQNVDTDVA SEQ ID NO: 96 | SASSRYS SEQ ID NO: 97 | QQYNNYPLT SEQ ID NO: 100 |
| huAFD.v2.5 | SYYMY SEQ ID NO: 85 | EINPYSGGTN FNEKFKS SEQ ID NO: 92 | EGGFAY SEQ ID NO: 95 | KASQNVDTDVA SEQ ID NO: 96 | SASSRYS SEQ ID NO: 97 | QQYNNYPLT SEQ ID NO: 100 |
| huAFD.v2.6 | SYYMY SEQ ID NO: 85 | EINPTSGGTN FNEKFKS SEQ ID NO: 87 | EGGFAY SEQ ID NO: 95 | KASQNVDTDVA SEQ ID NO: 96 | SASSRYS SEQ ID NO: 97 | QQYNNYPLT SEQ ID NO: 100 |
| huAFD.v2.7 | SYYMY SEQ ID NO: 85 | EINPTSGGTN FNEKFKS SEQ ID NO: 87 | EGGFAY SEQ ID NO: 95 | KASQNVDTDVA SEQ ID NO: 96 | SASSRYS SEQ ID NO: 97 | QQYNNYPLT SEQ ID NO: 100 |
| huAFD.v2.8 | SYYMY SEQ ID NO: 85 | EINPTSGGTN FNEKFKS SEQ ID NO: 87 | EGGFAY SEQ ID NO: 95 | KASQNVDTDVA SEQ ID NO: 96 | SASSRYS SEQ ID NO: 97 | QQYNNYPLT SEQ ID NO: 100 |
| huAFD.v2.9 | SYYMY SEQ ID NO: 85 | WINPTSGGTN FNEKFKS SEQ ID NO: 93 | EGGFAY SEQ ID NO: 95 | KASQNVDTDVA SEQ ID NO: 96 | SASSRYS SEQ ID NO: 97 | QQYNNYPLT SEQ ID NO: 100 |
| huAFD.v2.10 | SYYMY SEQ ID NO: 85 | EINPTSGGTN FNEKFKS SEQ ID NO: 87 | EGGFAY SEQ ID NO: 95 | KASQNVDTDVA SEQ ID NO: 96 | SASSRKS SEQ ID NO: 98 | QQYNNYPLT SEQ ID NO: 100 |
| huAFD.v2.11 | SYYMY SEQ ID NO: 85 | EINPTSGGTN FNEKFKS SEQ ID NO: 87 | EGGFAY SEQ ID NO: 95 | KASQNVDTDVA SEQ ID NO: 96 | SASSRRS SEQ ID NO: 99 | QQYNNYPLT SEQ ID NO: 100 |
| huAFD.v2.12 | SYYMY SEQ ID NO: 85 | EINPYSGGTN FNEKFKS SEQ ID NO: 92 | EGGFAY SEQ ID NO: 95 | KASQNVDTDVA SEQ ID NO: 96 | SASSRYS SEQ ID NO: 97 | QQYNNYPLT SEQ ID NO: 100 |
| huAFD.v2.13 | SYYMY SEQ ID NO: 85 | EINPTSGGTN FNEKFKS SEQ ID NO: 87 | EGGFAY SEQ ID NO: 95 | KASQNVDTDVA SEQ ID NO: 96 | SASSRYS SEQ ID NO: 97 | QQYENYPLT SEQ ID NO: 101 |

TABLE 2-continued

HVR amino acid sequences (in accordance with Kabat HVR definitions) of additional anti-Factor D antibodies

| Antibody | HVR-H1 | HVR-H2 | HVR-H3 | HVR-L1 | HVR-L2 | HVR-L3 |
|---|---|---|---|---|---|---|
| huAFD.v2.14 | SYYMY SEQ ID NO: 85 | EINPTSGETN FNEKFKS SEQ ID NO: 91 | EGGFAY SEQ ID NO: 95 | KASQNVDTDVA SEQ ID NO: 96 | SASSRYS SEQ ID NO: 97 | QQYNNYPLT SEQ ID NO: 101 |
| huAFD.v2.15 | SYYMY SEQ ID NO: 85 | EINPYSGETN FNEKFKS SEQ ID NO: 94 | EGGFAY SEQ ID NO: 95 | KASQNVDTDVA SEQ ID NO: 96 | SASSRYS SEQ ID NO: 97 | QQYNNYPLT SEQ ID NO: 100 |

In some embodiments, the antibody comprises an HVR-H1 comprising the amino acid sequence of SEQ ID NO: 1, an HVR-H2 comprising the amino acid sequence of SEQ ID NO: 2, and an HVR-H3 comprising the amino acid sequence of SEQ ID NO: 5.

In some embodiments, the antibody comprises an HVR-H1 comprising the amino acid sequence of SEQ ID NO: 1, an HVR-H2 comprising the amino acid sequence of SEQ ID NO: 3, and an HVR-H3 comprising the amino acid sequence of SEQ ID NO: 5.

In some embodiments, the antibody comprises an HVR-H1 comprising the amino acid sequence of SEQ ID NO: 1, an HVR-H2 comprising the amino acid sequence of SEQ ID NO: 4, and an HVR-H3 comprising the amino acid sequence of SEQ ID NO: 5.

In some embodiments, the antibody comprises an HVR-H1 comprising the amino acid sequence of SEQ ID NO: 1, an HVR-H2 comprising the amino acid sequence of SEQ ID NO: 3, and an HVR-H3 comprising the amino acid sequence of SEQ ID NO: 6.

In some embodiments, the antibody comprises an HVR-H1 comprising the amino acid sequence of SEQ ID NO: 1, an HVR-H2 comprising the amino acid sequence of SEQ ID NO: 3, and an HVR-H3 comprising the amino acid sequence of SEQ ID NO: 7.

In some embodiments, the antibody comprises an HVR-H1 comprising the amino acid sequence of SEQ ID NO: 1, an HVR-H2 comprising the amino acid sequence of SEQ ID NO: 3, and an HVR-H3 comprising the amino acid sequence of SEQ ID NO: 8.

In some embodiments, the antibody comprises an HVR-L1 comprising the amino acid sequence of SEQ ID NO: 9, an HVR-L2 comprising the amino acid sequence of SEQ ID NO: 18, and an HVR-L3 comprising the amino acid sequence of SEQ ID NO: 19.

In some embodiments, the antibody comprises an HVR-L1 comprising the amino acid sequence of SEQ ID NO: 10, an HVR-L2 comprising the amino acid sequence of SEQ ID NO: 18, and an HVR-L3 comprising the amino acid sequence of SEQ ID NO: 19.

In some embodiments, the antibody comprises an HVR-L1 comprising the amino acid sequence of SEQ ID NO: 11, an HVR-L2 comprising the amino acid sequence of SEQ ID NO: 18, and an HVR-L3 comprising the amino acid sequence of SEQ ID NO: 19.

In some embodiments, the antibody comprises an HVR-L1 comprising the amino acid sequence of SEQ ID NO: 12, an HVR-L2 comprising the amino acid sequence of SEQ ID NO: 18, and an HVR-L3 comprising the amino acid sequence of SEQ ID NO: 19.

In some embodiments, the antibody comprises an HVR-L1 comprising the amino acid sequence of SEQ ID NO: 13, an HVR-L2 comprising the amino acid sequence of SEQ ID NO: 18, and an HVR-L3 comprising the amino acid sequence of SEQ ID NO: 19.

In some embodiments, the antibody comprises an HVR-L1 comprising the amino acid sequence of SEQ ID NO: 14, an HVR-L2 comprising the amino acid sequence of SEQ ID NO: 18, and an HVR-L3 comprising the amino acid sequence of SEQ ID NO: 19.

In some embodiments, the antibody comprises an HVR-L1 comprising the amino acid sequence of SEQ ID NO: 15, an HVR-L2 comprising the amino acid sequence of SEQ ID NO: 18, and an HVR-L3 comprising the amino acid sequence of SEQ ID NO: 19.

In some embodiments, the antibody comprises an HVR-L1 comprising the amino acid sequence of SEQ ID NO: 15, an HVR-L2 comprising the amino acid sequence of SEQ ID NO: 18, and an HVR-L3 comprising the amino acid sequence of SEQ ID NO: 20.

In some embodiments, the antibody comprises an HVR-L1 comprising the amino acid sequence of SEQ ID NO: 16, an HVR-L2 comprising the amino acid sequence of SEQ ID NO: 18, and an HVR-L3 comprising the amino acid sequence of SEQ ID NO: 19.

In some embodiments, the antibody comprises an HVR-L1 comprising the amino acid sequence of SEQ ID NO: 17, an HVR-L2 comprising the amino acid sequence of SEQ ID NO: 18, and an HVR-L3 comprising the amino acid sequence of SEQ ID NO: 19.

In some embodiments, the antibody comprises an HVR-L1 comprising the amino acid sequence of SEQ ID NO: 16, an HVR-L2 comprising the amino acid sequence of SEQ ID NO: 18, and an HVR-L3 comprising the amino acid sequence of SEQ ID NO: 20.

In some embodiments, the antibody comprises an HVR-H1 comprising the amino acid sequence of SEQ ID NO: 1, an HVR-H2 comprising the amino acid sequence of SEQ ID NO: 2, an HVR-H3 comprising the amino acid sequence of SEQ ID NO: 5, an HVR-L1 comprising the amino acid sequence of SEQ ID NO: 9, an HVR-L2 comprising the amino acid sequence of SEQ ID NO: 18, and an HVR-L3 comprising the amino acid sequence of SEQ ID NO: 19.

In some embodiments, the antibody comprises an HVR-H1 comprising the amino acid sequence of SEQ ID NO: 1, an HVR-H2 comprising the amino acid sequence of SEQ ID NO: 2, an HVR-H3 comprising the amino acid sequence of SEQ ID NO: 5, an HVR-L1 comprising the amino acid sequence of SEQ ID NO: 10, an HVR-L2 comprising the amino acid sequence of SEQ ID NO: 18, and an HVR-L3 comprising the amino acid sequence of SEQ ID NO: 19.

In some embodiments, the antibody comprises an HVR-H1 comprising the amino acid sequence of SEQ ID NO: 1, an HVR-H2 comprising the amino acid sequence of SEQ ID NO: 2, an HVR-H3 comprising the amino acid sequence of SEQ ID NO: 5, an HVR-L1 comprising the amino acid sequence of SEQ ID NO: 11, an HVR-L2 comprising the amino acid sequence of SEQ ID NO: 18, and an HVR-L3 comprising the amino acid sequence of SEQ ID NO: 19.

In some embodiments, the antibody comprises an HVR-H1 comprising the amino acid sequence of SEQ ID NO: 1, an HVR-H2 comprising the amino acid sequence of SEQ ID NO: 2, an HVR-H3 comprising the amino acid sequence of SEQ ID NO: 5, an HVR-L1 comprising the amino acid sequence of SEQ ID NO: 12, an HVR-L2 comprising the amino acid sequence of SEQ ID NO: 18, and an HVR-L3 comprising the amino acid sequence of SEQ ID NO: 19.

In some embodiments, the antibody comprises an HVR-H1 comprising the amino acid sequence of SEQ ID NO: 1, an HVR-H2 comprising the amino acid sequence of SEQ ID NO: 2, an HVR-H3 comprising the amino acid sequence of SEQ ID NO: 5, an HVR-L1 comprising the amino acid sequence of SEQ ID NO: 13, an HVR-L2 comprising the amino acid sequence of SEQ ID NO: 18, and an HVR-L3 comprising the amino acid sequence of SEQ ID NO: 19.

In some embodiments, the antibody comprises an HVR-H1 comprising the amino acid sequence of SEQ ID NO: 1, an HVR-H2 comprising the amino acid sequence of SEQ ID NO: 2, an HVR-H3 comprising the amino acid sequence of SEQ ID NO: 5, an HVR-L1 comprising the amino acid sequence of SEQ ID NO: 14, an HVR-L2 comprising the amino acid sequence of SEQ ID NO: 18, and an HVR-L3 comprising the amino acid sequence of SEQ ID NO: 19.

In some embodiments, the antibody comprises an HVR-H1 comprising the amino acid sequence of SEQ ID NO: 1, an HVR-H2 comprising the amino acid sequence of SEQ ID NO: 3, an HVR-H3 comprising the amino acid sequence of SEQ ID NO: 5, an HVR-L1 comprising the amino acid sequence of SEQ ID NO: 15, an HVR-L2 comprising the amino acid sequence of SEQ ID NO: 18, and an HVR-L3 comprising the amino acid sequence of SEQ ID NO: 19.

In some embodiments, the antibody comprises an HVR-H1 comprising the amino acid sequence of SEQ ID NO: 1, an HVR-H2 comprising the amino acid sequence of SEQ ID NO: 3, an HVR-H3 comprising the amino acid sequence of SEQ ID NO: 5, an HVR-L1 comprising the amino acid sequence of SEQ ID NO: 15, an HVR-L2 comprising the amino acid sequence of SEQ ID NO: 18, and an HVR-L3 comprising the amino acid sequence of SEQ ID NO: 20.

In some embodiments, the antibody comprises an HVR-H1 comprising the amino acid sequence of SEQ ID NO: 1, an HVR-H2 comprising the amino acid sequence of SEQ ID NO: 3, an HVR-H3 comprising the amino acid sequence of SEQ ID NO: 5, an HVR-L1 comprising the amino acid sequence of SEQ ID NO: 16, an HVR-L2 comprising the amino acid sequence of SEQ ID NO: 18, and an HVR-L3 comprising the amino acid sequence of SEQ ID NO: 19.

In some embodiments, the antibody comprises an HVR-H1 comprising the amino acid sequence of SEQ ID NO: 1, an HVR-H2 comprising the amino acid sequence of SEQ ID NO: 3, an HVR-H3 comprising the amino acid sequence of SEQ ID NO: 5, an HVR-L1 comprising the amino acid sequence of SEQ ID NO: 17, an HVR-L2 comprising the amino acid sequence of SEQ ID NO: 18, and an HVR-L3 comprising the amino acid sequence of SEQ ID NO: 19.

In some embodiments, the antibody comprises an HVR-H1 comprising the amino acid sequence of SEQ ID NO: 1, an HVR-H2 comprising the amino acid sequence of SEQ ID NO: 3, an HVR-H3 comprising the amino acid sequence of SEQ ID NO: 5, an HVR-L1 comprising the amino acid sequence of SEQ ID NO: 16, an HVR-L2 comprising the amino acid sequence of SEQ ID NO: 18, and an HVR-L3 comprising the amino acid sequence of SEQ ID NO: 20.

In some embodiments, the antibody comprises an HVR-H1 comprising the amino acid sequence of SEQ ID NO: 1, an HVR-H2 comprising the amino acid sequence of SEQ ID NO: 4, an HVR-H3 comprising the amino acid sequence of SEQ ID NO: 5, an HVR-L1 comprising the amino acid sequence of SEQ ID NO: 16, an HVR-L2 comprising the amino acid sequence of SEQ ID NO: 18, and an HVR-L3 comprising the amino acid sequence of SEQ ID NO: 19.

In some embodiments, the antibody comprises an HVR-H1 comprising the amino acid sequence of SEQ ID NO: 1, an HVR-H2 comprising the amino acid sequence of SEQ ID NO: 3, an HVR-H3 comprising the amino acid sequence of SEQ ID NO: 6, an HVR-L1 comprising the amino acid sequence of SEQ ID NO: 16, an HVR-L2 comprising the amino acid sequence of SEQ ID NO: 18, and an HVR-L3 comprising the amino acid sequence of SEQ ID NO: 19.

In some embodiments, the antibody comprises an HVR-H1 comprising the amino acid sequence of SEQ ID NO: 1, an HVR-H2 comprising the amino acid sequence of SEQ ID NO: 3, an HVR-H3 comprising the amino acid sequence of SEQ ID NO: 7, an HVR-L1 comprising the amino acid sequence of SEQ ID NO: 16, an HVR-L2 comprising the amino acid sequence of SEQ ID NO: 18, and an HVR-L3 comprising the amino acid sequence of SEQ ID NO: 19.

In some embodiments, the antibody comprises an HVR-H1 comprising the amino acid sequence of SEQ ID NO: 1, an HVR-H2 comprising the amino acid sequence of SEQ ID NO: 3, an HVR-H3 comprising the amino acid sequence of SEQ ID NO: 8, an HVR-L1 comprising the amino acid sequence of SEQ ID NO: 16, an HVR-L2 comprising the amino acid sequence of SEQ ID NO: 18, and an HVR-L3 comprising the amino acid sequence of SEQ ID NO: 19.

In some embodiments, the antibody comprises an HVR-H1 comprising the amino acid sequence of SEQ ID NO: 1, an HVR-H2 comprising the amino acid sequence of SEQ ID NO: 3, an HVR-H3 comprising the amino acid sequence of SEQ ID NO: 8, an HVR-L1 comprising the amino acid sequence of SEQ ID NO: 16, an HVR-L2 comprising the amino acid sequence of SEQ ID NO: 18, and an HVR-L3 comprising the amino acid sequence of SEQ ID NO: 20.

In some embodiments, the antibody comprises an HVR-H1 comprising the amino acid sequence of SEQ ID NO: 85, an HVR-H2 comprising the amino acid sequence of SEQ ID NO: 86, and an HVR-H3 comprising the amino acid sequence of SEQ ID NO: 95.

In some embodiments, the antibody comprises an HVR-H1 comprising the amino acid sequence of SEQ ID NO: 85, an HVR-H2 comprising the amino acid sequence of SEQ ID NO: 87, and an HVR-H3 comprising the amino acid sequence of SEQ ID NO: 95.

In some embodiments, the antibody comprises an HVR-H1 comprising the amino acid sequence of SEQ ID NO: 85, an HVR-H2 comprising the amino acid sequence of SEQ ID NO: 88, and an HVR-H3 comprising the amino acid sequence of SEQ ID NO: 95.

In some embodiments, the antibody comprises an HVR-H1 comprising the amino acid sequence of SEQ ID NO: 85, an HVR-H2 comprising the amino acid sequence of SEQ ID NO: 89, and an HVR-H3 comprising the amino acid sequence of SEQ ID NO: 95.

In some embodiments, the antibody comprises an HVR-H1 comprising the amino acid sequence of SEQ ID NO: 85, an HVR-H2 comprising the amino acid sequence of SEQ ID NO: 90, and an HVR-H3 comprising the amino acid sequence of SEQ ID NO: 95.

In some embodiments, the antibody comprises an HVR-H1 comprising the amino acid sequence of SEQ ID NO: 85, an HVR-H2 comprising the amino acid sequence of SEQ ID NO: 91, and an HVR-H3 comprising the amino acid sequence of SEQ ID NO: 95.

In some embodiments, the antibody comprises an HVR-H1 comprising the amino acid sequence of SEQ ID NO: 85, an HVR-H2 comprising the amino acid sequence of SEQ ID NO: 92, and an HVR-H3 comprising the amino acid sequence of SEQ ID NO: 95.

In some embodiments, the antibody comprises an HVR-H1 comprising the amino acid sequence of SEQ ID NO: 85, an HVR-H2 comprising the amino acid sequence of SEQ ID NO: 93, and an HVR-H3 comprising the amino acid sequence of SEQ ID NO: 95.

In some embodiments, the antibody comprises an HVR-H1 comprising the amino acid sequence of SEQ ID NO: 85, an HVR-H2 comprising the amino acid sequence of SEQ ID NO: 94, and an HVR-H3 comprising the amino acid sequence of SEQ ID NO: 95.

In some embodiments, the antibody comprises an HVR-L1 comprising the amino acid sequence of SEQ ID NO: 96, an HVR-L2 comprising the amino acid sequence of SEQ ID NO: 97, and an HVR-L3 comprising the amino acid sequence of SEQ ID NO: 100.

In some embodiments, the antibody comprises an HVR-L1 comprising the amino acid sequence of SEQ ID NO: 96, an HVR-L2 comprising the amino acid sequence of SEQ ID NO: 98, and an HVR-L3 comprising the amino acid sequence of SEQ ID NO: 100.

In some embodiments, the antibody comprises an HVR-L1 comprising the amino acid sequence of SEQ ID NO: 96, an HVR-L2 comprising the amino acid sequence of SEQ ID NO: 99, and an HVR-L3 comprising the amino acid sequence of SEQ ID NO: 100.

In some embodiments, the antibody comprises an HVR-L1 comprising the amino acid sequence of SEQ ID NO: 96, an HVR-L2 comprising the amino acid sequence of SEQ ID NO: 97, and an HVR-L3 comprising the amino acid sequence of SEQ ID NO: 101.

In some embodiments, the antibody comprises an HVR-H1 comprising the amino acid sequence of SEQ ID NO: 85, an HVR-H2 comprising the amino acid sequence of SEQ ID NO: 86, an HVR-H3 comprising the amino acid sequence of SEQ ID NO: 95, an HVR-L1 comprising the amino acid sequence of SEQ ID NO: 96, an HVR-L2 comprising the amino acid sequence of SEQ ID NO: 97, and an HVR-L3 comprising the amino acid sequence of SEQ ID NO: 100.

In some embodiments, the antibody comprises an HVR-H1 comprising the amino acid sequence of SEQ ID NO: 85, an HVR-H2 comprising the amino acid sequence of SEQ ID NO: 87, an HVR-H3 comprising the amino acid sequence of SEQ ID NO: 95, an HVR-L1 comprising the amino acid sequence of SEQ ID NO: 96, an HVR-L2 comprising the amino acid sequence of SEQ ID NO: 97, and an HVR-L3 comprising the amino acid sequence of SEQ ID NO: 100.

In some embodiments, the antibody comprises an HVR-H1 comprising the amino acid sequence of SEQ ID NO: 85, an HVR-H2 comprising the amino acid sequence of SEQ ID NO: 88, an HVR-H3 comprising the amino acid sequence of SEQ ID NO: 95, an HVR-L1 comprising the amino acid sequence of SEQ ID NO: 96, an HVR-L2 comprising the amino acid sequence of SEQ ID NO: 97, and an HVR-L3 comprising the amino acid sequence of SEQ ID NO: 100.

In some embodiments, the antibody comprises an HVR-H1 comprising the amino acid sequence of SEQ ID NO: 85, an HVR-H2 comprising the amino acid sequence of SEQ ID NO: 89, an HVR-H3 comprising the amino acid sequence of SEQ ID NO: 95, an HVR-L1 comprising the amino acid sequence of SEQ ID NO: 96, an HVR-L2 comprising the amino acid sequence of SEQ ID NO: 97, and an HVR-L3 comprising the amino acid sequence of SEQ ID NO: 100.

In some embodiments, the antibody comprises an HVR-H1 comprising the amino acid sequence of SEQ ID NO: 85, an HVR-H2 comprising the amino acid sequence of SEQ ID NO: 90, an HVR-H3 comprising the amino acid sequence of SEQ ID NO: 95, an HVR-L1 comprising the amino acid sequence of SEQ ID NO: 96, an HVR-L2 comprising the amino acid sequence of SEQ ID NO: 97, and an HVR-L3 comprising the amino acid sequence of SEQ ID NO: 100.

In some embodiments, the antibody comprises an HVR-H1 comprising the amino acid sequence of SEQ ID NO: 85, an HVR-H2 comprising the amino acid sequence of SEQ ID NO: 91, an HVR-H3 comprising the amino acid sequence of SEQ ID NO: 95, an HVR-L1 comprising the amino acid sequence of SEQ ID NO: 96, an HVR-L2 comprising the amino acid sequence of SEQ ID NO: 97, and an HVR-L3 comprising the amino acid sequence of SEQ ID NO: 100.

In some embodiments, the antibody comprises an HVR-H1 comprising the amino acid sequence of SEQ ID NO: 85, an HVR-H2 comprising the amino acid sequence of SEQ ID NO: 92, an HVR-H3 comprising the amino acid sequence of SEQ ID NO: 95, an HVR-L1 comprising the amino acid sequence of SEQ ID NO: 96, an HVR-L2 comprising the amino acid sequence of SEQ ID NO: 97, and an HVR-L3 comprising the amino acid sequence of SEQ ID NO: 100.

In some embodiments, the antibody comprises an HVR-H1 comprising the amino acid sequence of SEQ ID NO: 85, an HVR-H2 comprising the amino acid sequence of SEQ ID NO: 93, an HVR-H3 comprising the amino acid sequence of SEQ ID NO: 95, an HVR-L1 comprising the amino acid sequence of SEQ ID NO: 96, an HVR-L2 comprising the amino acid sequence of SEQ ID NO: 97, and an HVR-L3 comprising the amino acid sequence of SEQ ID NO: 100.

In some embodiments, the antibody comprises an HVR-H1 comprising the amino acid sequence of SEQ ID NO: 85, an HVR-H2 comprising the amino acid sequence of SEQ ID NO: 87, an HVR-H3 comprising the amino acid sequence of SEQ ID NO: 95, an HVR-L1 comprising the amino acid sequence of SEQ ID NO: 96, an HVR-L2 comprising the amino acid sequence of SEQ ID NO: 98, and an HVR-L3 comprising the amino acid sequence of SEQ ID NO: 100.

In some embodiments, the antibody comprises an HVR-H1 comprising the amino acid sequence of SEQ ID NO: 85, an HVR-H2 comprising the amino acid sequence of SEQ ID NO: 87, an HVR-H3 comprising the amino acid sequence of SEQ ID NO: 95, an HVR-L1 comprising the amino acid sequence of SEQ ID NO: 96, an HVR-L2 comprising the amino acid sequence of SEQ ID NO: 99, and an HVR-L3 comprising the amino acid sequence of SEQ ID NO: 100.

In some embodiments, the antibody comprises an HVR-H1 comprising the amino acid sequence of SEQ ID NO: 85, an HVR-H2 comprising the amino acid sequence of SEQ ID NO: 87, an HVR-H3 comprising the amino acid sequence of SEQ ID NO: 95, an HVR-L1 comprising the amino acid sequence of SEQ ID NO: 96, an HVR-L2 comprising the amino acid sequence of SEQ ID NO: 97, and an HVR-L3 comprising the amino acid sequence of SEQ ID NO: 101.

In some embodiments, the antibody comprises an HVR-H1 comprising the amino acid sequence of SEQ ID NO: 85, an HVR-H2 comprising the amino acid sequence of SEQ ID NO: 94, an HVR-H3 comprising the amino acid sequence of SEQ ID NO: 95, an HVR-L1 comprising the amino acid sequence of SEQ ID NO: 96, an HVR-L2 comprising the amino acid sequence of SEQ ID NO: 97, and an HVR-L3 comprising the amino acid sequence of SEQ ID NO: 100.

In some embodiments, the antibody comprises a heavy chain variable domain having the amino acid sequence of SEQ ID NO: 21. In some embodiments, the antibody comprises a heavy chain variable domain having at least 90% sequence identity to the amino acid sequence of SEQ ID NO: 21. See Table 3.

In some embodiments, the antibody comprises a light chain variable domain having the amino acid sequence of SEQ ID NO: 22. In some embodiments, the antibody comprises a light chain variable domain having at least 90% sequence identity to the amino acid sequence of SEQ ID NO: 22. See Table 3.

In some embodiments, the antibody comprises a heavy chain variable domain having the amino acid sequence of SEQ ID NO: 21, and a light chain variable domain having the amino acid sequence of SEQ ID NO: 22. In some embodiments, the antibody comprises a heavy chain variable domain having at least 90% sequence identity to the amino acid sequence of SEQ ID NO: 21, and a light chain variable domain having at least 90% sequence identity to the amino acid sequence of SEQ ID NO: 22. See Table 3.

In some embodiments, the antibody comprises a heavy chain variable domain having the amino acid sequence of SEQ ID NO: 23. In some embodiments, the antibody comprises a heavy chain variable domain having at least 90% sequence identity to the amino acid sequence of SEQ ID NO: 23. See Table 3.

In some embodiments, the antibody comprises a light chain variable domain having the amino acid sequence of SEQ ID NO: 24. In some embodiments, the antibody comprises a light chain variable domain having at least 90% sequence identity to the amino acid sequence of SEQ ID NO: 24. See Table 3.

In some embodiments, the antibody comprises a heavy chain variable domain having the amino acid sequence of SEQ ID NO: 23, and a light chain variable domain having the amino acid sequence of SEQ ID NO: 24. In some embodiments, the antibody comprises a heavy chain variable domain having at least 90% sequence identity to the amino acid sequence of SEQ ID NO: 23, and a light chain variable domain having at least 90% sequence identity to the amino acid sequence of SEQ ID NO: 24. See Table 3.

In some embodiments, the antibody comprises a heavy chain variable domain having the amino acid sequence of SEQ ID NO: 25. In some embodiments, the antibody comprises a heavy chain variable domain having at least 90% sequence identity to the amino acid sequence of SEQ ID NO: 25. See Table 3.

In some embodiments, the antibody comprises a light chain variable domain having the amino acid sequence of SEQ ID NO: 26. In some embodiments, the antibody comprises a light chain variable domain having at least 90% sequence identity to the amino acid sequence of SEQ ID NO: 26. See Table 3.

In some embodiments, the antibody comprises a heavy chain variable domain having the amino acid sequence of SEQ ID NO: 25, and a light chain variable domain having the amino acid sequence of SEQ ID NO: 26. In some embodiments, the antibody comprises a heavy chain variable domain having at least 90% sequence identity to the amino acid sequence of SEQ ID NO: 25, and a light chain variable domain having at least 90% sequence identity to the amino acid sequence of SEQ ID NO: 26. See Table 3.

In some embodiments, the antibody comprises a heavy chain variable domain having the amino acid sequence of SEQ ID NO: 27. In some embodiments, the antibody comprises a heavy chain variable domain having at least 90% sequence identity to the amino acid sequence of SEQ ID NO: 27. See Table 3.

In some embodiments, the antibody comprises a light chain variable domain having the amino acid sequence of SEQ ID NO: 28. In some embodiments, the antibody comprises a light chain variable domain having at least 90% sequence identity to the amino acid sequence of SEQ ID NO: 28. See Table 3.

In some embodiments, the antibody comprises a heavy chain variable domain having the amino acid sequence of SEQ ID NO: 27, and a light chain variable domain having the amino acid sequence of SEQ ID NO: 28. In some embodiments, the antibody comprises a heavy chain variable domain having at least 90% sequence identity to the amino acid sequence of SEQ ID NO: 27, and a light chain variable domain having at least 90% sequence identity to the amino acid sequence of SEQ ID NO: 28. See Table 3.

In some embodiments, the antibody comprises a heavy chain variable domain having the amino acid sequence of SEQ ID NO: 29. In some embodiments, the antibody comprises a heavy chain variable domain having at least 90% sequence identity to the amino acid sequence of SEQ ID NO: 29. See Table 3.

In some embodiments, the antibody comprises a light chain variable domain having the amino acid sequence of SEQ ID NO: 30. In some embodiments, the antibody comprises a light chain variable domain having at least 90% sequence identity to the amino acid sequence of SEQ ID NO: 30. See Table 3.

In some embodiments, the antibody comprises a heavy chain variable domain having the amino acid sequence of SEQ ID NO: 29, and a light chain variable domain having the amino acid sequence of SEQ ID NO: 30. In some embodiments, the antibody comprises a heavy chain variable domain having at least 90% sequence identity to the amino acid sequence of SEQ ID NO: 29, and a light chain variable domain having at least 90% sequence identity to the amino acid sequence of SEQ ID NO: 30. See Table 3.

In some embodiments, the antibody comprises a heavy chain variable domain having the amino acid sequence of SEQ ID NO: 31. In some embodiments, the antibody comprises a heavy chain variable domain having at least 90% sequence identity to the amino acid sequence of SEQ ID NO: 31. See Table 3.

In some embodiments, the antibody comprises a light chain variable domain having the amino acid sequence of SEQ ID NO: 32. In some embodiments, the antibody comprises a light chain variable domain having at least 90% sequence identity to the amino acid sequence of SEQ ID NO: 32. See Table 3.

In some embodiments, the antibody comprises a heavy chain variable domain having the amino acid sequence of SEQ ID NO: 31, and a light chain variable domain having the amino acid sequence of SEQ ID NO: 32. In some embodiments, the antibody comprises a heavy chain variable domain having at least 90% sequence identity to the amino acid sequence of SEQ ID NO: 31, and a light chain variable domain having at least 90% sequence identity to the amino acid sequence of SEQ ID NO: 32. See Table 3.

In some embodiments, the antibody comprises a heavy chain variable domain having the amino acid sequence of SEQ ID NO: 33. In some embodiments, the antibody comprises a heavy chain variable domain having at least 90% sequence identity to the amino acid sequence of SEQ ID NO: 33. See Table 3.

In some embodiments, the antibody comprises a light chain variable domain having the amino acid sequence of SEQ ID NO: 34. In some embodiments, the antibody comprises a light chain variable domain having at least 90% sequence identity to the amino acid sequence of SEQ ID NO: 34. See Table 3.

In some embodiments, the antibody comprises a heavy chain variable domain having the amino acid sequence of SEQ ID NO: 33, and a light chain variable domain having the amino acid sequence of SEQ ID NO: 34. In some embodiments, the antibody comprises a heavy chain variable domain having at least 90% sequence identity to the amino acid sequence of SEQ ID NO: 33, and a light chain variable domain having at least 90% sequence identity to the amino acid sequence of SEQ ID NO: 34. See Table 3.

In some embodiments, the antibody comprises a heavy chain variable domain having the amino acid sequence of SEQ ID NO: 35. In some embodiments, the antibody comprises a heavy chain variable domain having at least 90% sequence identity to the amino acid sequence of SEQ ID NO: 35. See Table 3.

In some embodiments, the antibody comprises a light chain variable domain having the amino acid sequence of SEQ ID NO: 36. In some embodiments, the antibody comprises a light chain variable domain having at least 90% sequence identity to the amino acid sequence of SEQ ID NO: 36. See Table 3.

In some embodiments, the antibody comprises a heavy chain variable domain having the amino acid sequence of SEQ ID NO: 35, and a light chain variable domain having the amino acid sequence of SEQ ID NO: 36. In some embodiments, the antibody comprises a heavy chain variable domain having at least 90% sequence identity to the amino acid sequence of SEQ ID NO: 35, and a light chain variable domain having at least 90% sequence identity to the amino acid sequence of SEQ ID NO: 36. See Table 3.

In some embodiments, the antibody comprises a heavy chain variable domain having the amino acid sequence of SEQ ID NO: 37. In some embodiments, the antibody comprises a heavy chain variable domain having at least 90% sequence identity to the amino acid sequence of SEQ ID NO: 37. See Table 3.

In some embodiments, the antibody comprises a light chain variable domain having the amino acid sequence of SEQ ID NO: 38. In some embodiments, the antibody comprises a light chain variable domain having at least 90% sequence identity to the amino acid sequence of SEQ ID NO: 38. See Table 3.

In some embodiments, the antibody comprises a heavy chain variable domain having the amino acid sequence of SEQ ID NO: 37, and a light chain variable domain having the amino acid sequence of SEQ ID NO: 38. In some embodiments, the antibody comprises a heavy chain variable domain having at least 90% sequence identity to the amino acid sequence of SEQ ID NO: 37, and a light chain variable domain having at least 90% sequence identity to the amino acid sequence of SEQ ID NO: 38. See Table 3.

In some embodiments, the antibody comprises a heavy chain variable domain having the amino acid sequence of SEQ ID NO: 39. In some embodiments, the antibody comprises a heavy chain variable domain having at least 90% sequence identity to the amino acid sequence of SEQ ID NO: 39. See Table 3.

In some embodiments, the antibody comprises a light chain variable domain having the amino acid sequence of SEQ ID NO: 40. In some embodiments, the antibody comprises a light chain variable domain having at least 90% sequence identity to the amino acid sequence of SEQ ID NO: 40. See Table 3.

In some embodiments, the antibody comprises a heavy chain variable domain having the amino acid sequence of SEQ ID NO: 39, and a light chain variable domain having the amino acid sequence of SEQ ID NO: 40. In some embodiments, the antibody comprises a heavy chain variable domain having at least 90% sequence identity to the amino acid sequence of SEQ ID NO: 39, and a light chain variable domain having at least 90% sequence identity to the amino acid sequence of SEQ ID NO: 40. See Table 3.

In some embodiments, the antibody comprises a heavy chain variable domain having the amino acid sequence of SEQ ID NO: 41. In some embodiments, the antibody comprises a heavy chain variable domain having at least 90% sequence identity to the amino acid sequence of SEQ ID NO: 41. See Table 3.

In some embodiments, the antibody comprises a light chain variable domain having the amino acid sequence of SEQ ID NO: 42. In some embodiments, the antibody comprises a light chain variable domain having at least 90% sequence identity to the amino acid sequence of SEQ ID NO: 42. See Table 3.

In some embodiments, the antibody comprises a heavy chain variable domain having the amino acid sequence of SEQ ID NO: 41, and a light chain variable domain having the amino acid sequence of SEQ ID NO: 42. In some embodiments, the antibody comprises a heavy chain variable domain having at least 90% sequence identity to the amino acid sequence of SEQ ID NO: 41, and a light chain variable domain having at least 90% sequence identity to the amino acid sequence of SEQ ID NO: 42. See Table 3.

In some embodiments, the antibody comprises a heavy chain variable domain having the amino acid sequence of SEQ ID NO: 43. In some embodiments, the antibody comprises a heavy chain variable domain having at least 90% sequence identity to the amino acid sequence of SEQ ID NO: 43. See Table 3.

In some embodiments, the antibody comprises a light chain variable domain having the amino acid sequence of SEQ ID NO: 44. In some embodiments, the antibody comprises a light chain variable domain having at least 90% sequence identity to the amino acid sequence of SEQ ID NO: 44. See Table 3.

In some embodiments, the antibody comprises a heavy chain variable domain having the amino acid sequence of SEQ ID NO: 43, and a light chain variable domain having the amino acid sequence of SEQ ID NO: 44. In some embodiments, the antibody comprises a heavy chain variable domain having at least 90% sequence identity to the amino acid sequence of SEQ ID NO: 43, and a light chain variable domain having at least 90% sequence identity to the amino acid sequence of SEQ ID NO: 44. See Table 3.

In some embodiments, the antibody comprises a heavy chain variable domain having the amino acid sequence of SEQ ID NO: 45. In some embodiments, the antibody comprises a heavy chain variable domain having at least 90% sequence identity to the amino acid sequence of SEQ ID NO: 45. See Table 3.

In some embodiments, the antibody comprises a light chain variable domain having the amino acid sequence of SEQ ID NO: 46. In some embodiments, the antibody comprises a light chain variable domain having at least 90% sequence identity to the amino acid sequence of SEQ ID NO: 46. See Table 3.

In some embodiments, the antibody comprises a heavy chain variable domain having the amino acid sequence of SEQ ID NO: 45, and a light chain variable domain having the amino acid sequence of SEQ ID NO: 46. In some embodiments, the antibody comprises a heavy chain variable domain having at least 90% sequence identity to the amino acid sequence of SEQ ID NO: 45, and a light chain variable domain having at least 90% sequence identity to the amino acid sequence of SEQ ID NO: 46. See Table 3.

In some embodiments, the antibody comprises a heavy chain variable domain having the amino acid sequence of SEQ ID NO: 47. In some embodiments, the antibody comprises a heavy chain variable domain having at least 90% sequence identity to the amino acid sequence of SEQ ID NO: 47. See Table 3.

In some embodiments, the antibody comprises a light chain variable domain having the amino acid sequence of SEQ ID NO: 48. In some embodiments, the antibody comprises a light chain variable domain having at least 90% sequence identity to the amino acid sequence of SEQ ID NO: 48. See Table 3.

In some embodiments, the antibody comprises a heavy chain variable domain having the amino acid sequence of SEQ ID NO: 47, and a light chain variable domain having the amino acid sequence of SEQ ID NO: 48. In some embodiments, the antibody comprises a heavy chain variable domain having at least 90% sequence identity to the amino acid sequence of SEQ ID NO: 47, and a light chain variable domain having at least 90% sequence identity to the amino acid sequence of SEQ ID NO: 48. See Table 3.

In some embodiments, the antibody comprises a heavy chain variable domain having the amino acid sequence of SEQ ID NO: 49. In some embodiments, the antibody comprises a heavy chain variable domain having at least 90% sequence identity to the amino acid sequence of SEQ ID NO: 49. See Table 3.

In some embodiments, the antibody comprises a light chain variable domain having the amino acid sequence of SEQ ID NO: 50. In some embodiments, the antibody comprises a light chain variable domain having at least 90% sequence identity to the amino acid sequence of SEQ ID NO: 50. See Table 3.

In some embodiments, the antibody comprises a heavy chain variable domain having the amino acid sequence of SEQ ID NO: 49, and a light chain variable domain having the amino acid sequence of SEQ ID NO: 50. In some embodiments, the antibody comprises a heavy chain variable domain having at least 90% sequence identity to the amino acid sequence of SEQ ID NO: 49, and a light chain variable domain having at least 90% sequence identity to the amino acid sequence of SEQ ID NO: 50. See Table 3.

In some embodiments, the antibody comprises a heavy chain variable domain having the amino acid sequence of SEQ ID NO: 51. In some embodiments, the antibody comprises a heavy chain variable domain having at least 90% sequence identity to the amino acid sequence of SEQ ID NO: 51. See Table 3.

In some embodiments, the antibody comprises a light chain variable domain having the amino acid sequence of SEQ ID NO: 52. In some embodiments, the antibody comprises a light chain variable domain having at least 90% sequence identity to the amino acid sequence of SEQ ID NO: 52. See Table 3.

In some embodiments, the antibody comprises a heavy chain variable domain having the amino acid sequence of SEQ ID NO: 51, and a light chain variable domain having the amino acid sequence of SEQ ID NO: 52. In some embodiments, the antibody comprises a heavy chain variable domain having at least 90% sequence identity to the amino acid sequence of SEQ ID NO: 51, and a light chain variable domain having at least 90% sequence identity to the amino acid sequence of SEQ ID NO: 52. See Table 3.

TABLE 3

Heavy chain and light chain variable domain amino acid sequences of anti-Factor D antibodies

| | | |
|---|---|---|
| SEQ ID NO: 21 | AFD WT Heavy Chain Variable Region | EVQLVQSGPELKKPGASVKVSCKASGYTFTNYGMNWVRQAPGQGLEWMG WINTYTGETTYADDFKGRFVFSLDTSVSTAYLQISSLKAEDTAVYYCEREGG VNNWGQGTLVTVSS |
| SEQ ID NO: 22 | AFD WT Light Chain Variable Region | DIQVTQSPSSLSASVGDRVTITCITSTDIDDDMNWYQQKPGKVPKLLISGGNT LRPGVPSRFSGSGSGTDFTLTISSLQPEDVATYYCLQSDSLPYTFGQGTKVEIK |
| SEQ ID NO: 23 | AFD.v1 Heavy Chain Variable Region | EVQLVQSGPELKKPGASVKVSCKASGYTFTNYGMNWVRQAPGQGLEWMG WINTYTGETTYADDFKGRFVFSLDTSVSTAYLQISSLKAEDTAVYYCEREGG VNNWGQGTLVTVSS |
| SEQ ID NO: 24 | AFD.v1 Light Chain Variable Region | DIQVTQSPSSLSASVGDRVTITCITSTSIDDDMNWYQQKPGKVPKLLISGGNT LRPGVPSRFSGSGSGTDFTLTISSLQPEDVATYYCLQSDSLPYTFGQGTKVEIK |
| SEQ ID NO: 25 | AFD.v2 Heavy Chain Variable Region | EVQLVQSGPELKKPGASVKVSCKASGYTFTNYGMNWVRQAPGQGLEWMG WINTYTGETTYADDFKGRFVFSLDTSVSTAYLQISSLKAEDTAVYYCEREGG VNNWGQGTLVTVSS |
| SEQ ID NO: 26 | AFD.v2 Light Chain Variable Region | DIQVTQSPSSLSASVGDRVTITCITSTDIEDDMNWYQQKPGKVPKLLISGGNT LRPGVPSRFSGSGSGTDFTLTISSLQPEDVATYYCLQSDSLPYTFGQGTKVEIK |
| SEQ ID NO: 27 | AFD.v3 Heavy Chain Variable Region | EVQLVQSGPELKKPGASVKVSCKASGYTFTNYGMNWVRQAPGQGLEWMG WINTYTGETTYADDFKGRFVFSLDTSVSTAYLQISSLKAEDTAVYYCEREGG VNNWGQGTLVTVSS |
| SEQ ID NO: 28 | AFD.v3 Light Chain Variable Region | DIQVTQSPSSLSASVGDRVTITCITSTDIDSDMNWYQQKPGKVPKLLISGGNT LRPGVPSRFSGSGSGTDFTLTISSLQPEDVATYYCLQSDSLPYTFGQGTKVEIK |
| SEQ ID NO: 29 | AFD.v4 Heavy Chain Variable Region | EVQLVQSGPELKKPGASVKVSCKASGYTFTNYGMNWVRQAPGQGLEWMG WINTYTGETTYADDFKGRFVFSLDTSVSTAYLQISSLKAEDTAVYYCEREGG VNNWGQGTLVTVSS |

TABLE 3-continued

Heavy chain and light chain variable domain amino acid sequences of anti-Factor D antibodies

| | | |
|---|---|---|
| SEQ ID NO: 30 | AFD.v4 Light Chain Variable Region | DIQVTQSPSSLSASVGDRVTITCITSTDIDDSMNWYQQKPGKVPKLLISGGNTLRPGVPSRFSGSGSGTDFTLTISSLQPEDVATYYCLQSDSLPYTFGQGTKVEIK |
| SEQ ID NO: 31 | AFD.v5 Heavy Chain Variable Region | EVQLVQSGPELKKPGASVKVSCKASGYTFTNYGMNWVRQAPGQGLEWMGWINTYTGETTYADDFKGRFVFSLDTSVSTAYLQISSLKAEDTAVYYCEREGGVNNWGQGTLVTVSS |
| SEQ ID NO: 32 | AFD.v5 Light Chain Variable Region | DIQVTQSPSSLSASVGDRVTITCITSTSIDSSMNWYQQKPGKVPKLLISGGNTLRPGVPSRFSGSGSGTDFTLTISSLQPEDVATYYCLQSDSLPYTFGQGTKVEIK |
| SEQ ID NO: 33 | AFD.v6 Heavy Chain Variable Region | EVQLVQSGPELKKPGASVKVSCKASGYTFTNYGMNWVRQAPGQGLEWMGWINTYTGETTYAEDFKGRFVFSLDTSVSTAYLQISSLKAEDTAVYYCEREGGVNNWGQGTLVTVSS |
| SEQ ID NO: 34 | AFD.v6 Light Chain Variable Region | DIQVTQSPSSLSASVGDRVTITCITSTDIESDMNWYQQKPGKVPKLLISGGNTLRPGVPSRFSGSGSGTDFTLTISSLQPEDVATYYCLQSDSLPYTFGQGTKVEIK |
| SEQ ID NO: 35 | AFD.v7 Heavy Chain Variable Region | EVQLVQSGPELKKPGASVKVSCKASGYTFTNYGMNWVRQAPGQGLEWMGWINTYTGETTYAEDFKGRFVFSLDTSVSTAYLQISSLKAEDTAVYYCEREGGVNNWGQGTLVTVSS |
| SEQ ID NO: 36 | AFD.v7 Light Chain Variable Region | DIQVTQSPSSLSASVGDRVTITCITSTDIESDMNWYQQKPGKVPKLLISGGNTLRPGVPSRFSGSGSGTDFTLTISSLQPEDVATYYCLQSESLPYTFGQGTKVEIK |
| SEQ ID NO: 37 | AFD.v8 Heavy Chain Variable Region | EVQLVQSGPELKKPGASVKVSCKASGYTFTNYGMNWVRQAPGQGLEWMGWINTYTGETTYAEDFKGRFVFSLDTSVSTAYLQISSLKAEDTAVYYCEREGGVNNWGQGTLVTVSS |
| SEQ ID NO: 38 | AFD.v8 Light Chain Variable Region | DIQVTQSPSSLSASVGDRVTITCITSTSIESDMNWYQQKPGKVPKLLISGGNTLRPGVPSRFSGSGSGTDFTLTISSLQPEDVATYYCLQSDSLPYTFGQGTKVEIK |
| SEQ ID NO: 39 | AFD.v9 Heavy Chain Variable Region | EVQLVQSGPELKKPGASVKVSCKASGYTFTNYGMNWVRQAPGQGLEWMGWINTYTGETTYAEDFKGRFVFSLDTSVSTAYLQISSLKAEDTAVYYCEREGGVNNWGQGTLVTVSS |
| SEQ ID NO: 40 | AFD.v9 Light Chain Variable Region | DIQVTQSPSSLSASVGDRVTITCITSTSIESDMSWYQQKPGKVPKLLISGGNTLRPGVPSRFSGSGSGTDFTLTISSLQPEDVATYYCLQSDSLPYTFGQGTKVEIK |
| SEQ ID NO: 41 | AFD.v10 Heavy Chain Variable Region | EVQLVQSGPELKKPGASVKVSCKASGYTFTNYGMNWVRQAPGQGLEWMGWINTYTGETTYAEDFKGRFVFSLDTSVSTAYLQISSLKAEDTAVYYCEREGGVNNWGQGTLVTVSS |
| SEQ ID NO: 42 | AFD.v10 Light Chain Variable Region | DIQVTQSPSSLSASVGDRVTITCITSTSIESDMNWYQQKPGKVPKLLISGGNTLRPGVPSRFSGSGSGTDFTLTISSLQPEDVATYYCLQSESLPYTFGQGTKVEIK |
| SEQ ID NO: 43 | AFD.v11 Heavy Chain Variable Region | EVQLVQSGPELKKPGASVKVSCKASGYTFTNYGMNWVRQAPGQGLEWMGWISTYTGETTYAEDFKGRFVFSLDTSVSTAYLQISSLKAEDTAVYYCEREGGVNNWGQGTLVTVSS |
| SEQ ID NO: 44 | AFD.v11 Light Chain Variable Region | DIQVTQSPSSLSASVGDRVTITCITSTSIESDMNWYQQKPGKVPKLLISGGNTLRPGVPSRFSGSGSGTDFTLTISSLQPEDVATYYCLQSDSLPYTFGQGTKVEIK |
| SEQ ID NO: 45 | AFD.v12 Heavy Chain Variable Region | EVQLVQSGPELKKPGASVKVSCKASGYTFTNYGMNWVRQAPGQGLEWMGWINTYTGETTYAEDFKGRFVFSLDTSVSTAYLQISSLKAEDTAVYYCEREGGVDNWGQGTLVTVSS |
| SEQ ID NO: 46 | AFD.v12 Light Chain Variable Region | DIQVTQSPSSLSASVGDRVTITCITSTSIESDMNWYQQKPGKVPKLLISGGNTLRPGVPSRFSGSGSGTDFTLTISSLQPEDVATYYCLQSDSLPYTFGQGTKVEIK |
| SEQ ID NO: 47 | AFD.v13 Heavy Chain Variable Region | EVQLVQSGPELKKPGASVKVSCKASGYTFTNYGMNWVRQAPGQGLEWMGWINTYTGETTYAEDFKGRFVFSLDTSVSTAYLQISSLKAEDTAVYYCEREGGVQNWGQGTLVTVSS |
| SEQ ID NO: 48 | AFD.v13 Light Chain Variable Region | DIQVTQSPSSLSASVGDRVTITCITSTSIESDMNWYQQKPGKVPKLLISGGNTLRPGVPSRFSGSGSGTDFTLTISSLQPEDVATYYCLQSDSLPYTFGQGTKVEIK |
| SEQ ID NO: 49 | AFD.v14 Heavy Chain Variable Region | EVQLVQSGPELKKPGASVKVSCKASGYTFTNYGMNWVRQAPGQGLEWMGWINTYTGETTYAEDFKGRFVFSLDTSVSTAYLQISSLKAEDTAVYYCEREGGVSNWGQGTLVTVSS |
| SEQ ID NO: 50 | AFD.v14 Light Chain Variable Region | DIQVTQSPSSLSASVGDRVTITCITSTSIESDMNWYQQKPGKVPKLLISGGNTLRPGVPSRFSGSGSGTDFTLTISSLQPEDVATYYCLQSDSLPYTFGQGTKVEIK |
| SEQ ID NO: 51 | AFD.v15 Heavy Chain Variable Region | EVQLVQSGPELKKPGASVKVSCKASGYTFTNYGMNWVRQAPGQGLEWMGWINTYTGETTYAEDFKGRFVFSLDTSVSTAYLQISSLKAEDTAVYYCEREGGVSNWGQGTLVTVSS |

TABLE 3-continued

Heavy chain and light chain variable domain amino acid sequences of anti-Factor D antibodies

| SEQ ID NO: 52 | AFD.v15 Light Chain Variable Region | DIQVTQSPSSLSASVGDRVTITCITSTSIESDMNWYQQKPGKVPKLLISGGNTL RPGVPSRFSGSGSGTDFTLTISSLQPEDVATYYCLQSESLPYTFGQGTKVEIK |
|---|---|---|

In some embodiments, the antibody comprises a heavy chain variable domain having the amino acid sequence of SEQ ID NO: 102. In some embodiments, the antibody comprises a heavy chain variable domain having at least 90% sequence identity to the amino acid sequence of SEQ ID NO: 102. See Table 4.

In some embodiments, the antibody comprises a light chain variable domain having the amino acid sequence of SEQ ID NO: 103. In some embodiments, the antibody comprises a light chain variable domain having at least 90% sequence identity to the amino acid sequence of SEQ ID NO: 103. See Table 4.

In some embodiments, the antibody comprises a heavy chain variable domain having the amino acid sequence of SEQ ID NO: 102, and a light chain variable domain having the amino acid sequence of SEQ ID NO: 103. In some embodiments, the antibody comprises a heavy chain variable domain having at least 90% sequence identity to the amino acid sequence of SEQ ID NO: 102, and a light chain variable domain having at least 90% sequence identity to the amino acid sequence of SEQ ID NO: 103. See Table 4.

In some embodiments, the antibody comprises a heavy chain variable domain having the amino acid sequence of SEQ ID NO: 104. In some embodiments, the antibody comprises a heavy chain variable domain having at least 90% sequence identity to the amino acid sequence of SEQ ID NO: 104. See Table 4.

In some embodiments, the antibody comprises a light chain variable domain having the amino acid sequence of SEQ ID NO: 105. In some embodiments, the antibody comprises a light chain variable domain having at least 90% sequence identity to the amino acid sequence of SEQ ID NO: 105. See Table 4.

In some embodiments, the antibody comprises a heavy chain variable domain having the amino acid sequence of SEQ ID NO: 104, and a light chain variable domain having the amino acid sequence of SEQ ID NO: 105. In some embodiments, the antibody comprises a heavy chain variable domain having at least 90% sequence identity to the amino acid sequence of SEQ ID NO: 104, and a light chain variable domain having at least 90% sequence identity to the amino acid sequence of SEQ ID NO: 105. See Table 4.

In some embodiments, the antibody comprises a heavy chain variable domain having the amino acid sequence of SEQ ID NO: 106. In some embodiments, the antibody comprises a heavy chain variable domain having at least 90% sequence identity to the amino acid sequence of SEQ ID NO: 106. See Table 4.

In some embodiments, the antibody comprises a light chain variable domain having the amino acid sequence of SEQ ID NO: 107. In some embodiments, the antibody comprises a light chain variable domain having at least 90% sequence identity to the amino acid sequence of SEQ ID NO: 107. See Table 4.

In some embodiments, the antibody comprises a heavy chain variable domain having the amino acid sequence of SEQ ID NO: 106, and a light chain variable domain having the amino acid sequence of SEQ ID NO: 107. In some embodiments, the antibody comprises a heavy chain variable domain having at least 90% sequence identity to the amino acid sequence of SEQ ID NO: 106, and a light chain variable domain having at least 90% sequence identity to the amino acid sequence of SEQ ID NO: 107. See Table 4.

In some embodiments, the antibody comprises a heavy chain variable domain having the amino acid sequence of SEQ ID NO: 108. In some embodiments, the antibody comprises a heavy chain variable domain having at least 90% sequence identity to the amino acid sequence of SEQ ID NO: 108. See Table 4.

In some embodiments, the antibody comprises a light chain variable domain having the amino acid sequence of SEQ ID NO: 109. In some embodiments, the antibody comprises a light chain variable domain having at least 90% sequence identity to the amino acid sequence of SEQ ID NO: 109. See Table 4.

In some embodiments, the antibody comprises a heavy chain variable domain having the amino acid sequence of SEQ ID NO: 108, and a light chain variable domain having the amino acid sequence of SEQ ID NO: 109. In some embodiments, the antibody comprises a heavy chain variable domain having at least 90% sequence identity to the amino acid sequence of SEQ ID NO: 108, and a light chain variable domain having at least 90% sequence identity to the amino acid sequence of SEQ ID NO: 109. See Table 4.

In some embodiments, the antibody comprises a heavy chain variable domain having the amino acid sequence of SEQ ID NO: 110. In some embodiments, the antibody comprises a heavy chain variable domain having at least 90% sequence identity to the amino acid sequence of SEQ ID NO: 110. See Table 4.

In some embodiments, the antibody comprises a light chain variable domain having the amino acid sequence of SEQ ID NO: 111. In some embodiments, the antibody comprises a light chain variable domain having at least 90% sequence identity to the amino acid sequence of SEQ ID NO: 111. See Table 4.

In some embodiments, the antibody comprises a heavy chain variable domain having the amino acid sequence of SEQ ID NO: 110, and a light chain variable domain having the amino acid sequence of SEQ ID NO: 111. In some embodiments, the antibody comprises a heavy chain variable domain having at least 90% sequence identity to the amino acid sequence of SEQ ID NO: 110, and a light chain variable domain having at least 90% sequence identity to the amino acid sequence of SEQ ID NO: 111. See Table 4.

In some embodiments, the antibody comprises a heavy chain variable domain having the amino acid sequence of SEQ ID NO: 112. In some embodiments, the antibody comprises a heavy chain variable domain having at least 90% sequence identity to the amino acid sequence of SEQ ID NO: 112. See Table 4.

In some embodiments, the antibody comprises a light chain variable domain having the amino acid sequence of SEQ ID NO: 113. In some embodiments, the antibody comprises a light chain variable domain having at least 90% sequence identity to the amino acid sequence of SEQ ID NO: 113. See Table 4.

In some embodiments, the antibody comprises a heavy chain variable domain having the amino acid sequence of SEQ ID NO: 112, and a light chain variable domain having the amino acid sequence of SEQ ID NO: 113. In some embodiments, the antibody comprises a heavy chain variable domain having at least 90% sequence identity to the amino acid sequence of SEQ ID NO: 112, and a light chain variable domain having at least 90% sequence identity to the amino acid sequence of SEQ ID NO: 113. See Table 4.

In some embodiments, the antibody comprises a heavy chain variable domain having the amino acid sequence of SEQ ID NO: 114. In some embodiments, the antibody comprises a heavy chain variable domain having at least 90% sequence identity to the amino acid sequence of SEQ ID NO: 114. See Table 4.

In some embodiments, the antibody comprises a light chain variable domain having the amino acid sequence of SEQ ID NO: 115. In some embodiments, the antibody comprises a light chain variable domain having at least 90% sequence identity to the amino acid sequence of SEQ ID NO: 115. See Table 4.

In some embodiments, the antibody comprises a heavy chain variable domain having the amino acid sequence of SEQ ID NO: 114, and a light chain variable domain having the amino acid sequence of SEQ ID NO: 115. In some embodiments, the antibody comprises a heavy chain variable domain having at least 90% sequence identity to the amino acid sequence of SEQ ID NO: 114, and a light chain variable domain having at least 90% sequence identity to the amino acid sequence of SEQ ID NO: 115. See Table 4.

In some embodiments, the antibody comprises a heavy chain variable domain having the amino acid sequence of SEQ ID NO: 116. In some embodiments, the antibody comprises a heavy chain variable domain having at least 90% sequence identity to the amino acid sequence of SEQ ID NO: 116. See Table 4.

In some embodiments, the antibody comprises a light chain variable domain having the amino acid sequence of SEQ ID NO: 117. In some embodiments, the antibody comprises a light chain variable domain having at least 90% sequence identity to the amino acid sequence of SEQ ID NO: 117. See Table 4.

In some embodiments, the antibody comprises a heavy chain variable domain having the amino acid sequence of SEQ ID NO: 116, and a light chain variable domain having the amino acid sequence of SEQ ID NO: 117. In some embodiments, the antibody comprises a heavy chain variable domain having at least 90% sequence identity to the amino acid sequence of SEQ ID NO: 116, and a light chain variable domain having at least 90% sequence identity to the amino acid sequence of SEQ ID NO: 117. See Table 4.

In some embodiments, the antibody comprises a heavy chain variable domain having the amino acid sequence of SEQ ID NO: 118. In some embodiments, the antibody comprises a heavy chain variable domain having at least 90% sequence identity to the amino acid sequence of SEQ ID NO: 118. See Table 4.

In some embodiments, the antibody comprises a light chain variable domain having the amino acid sequence of SEQ ID NO: 119. In some embodiments, the antibody comprises a light chain variable domain having at least 90% sequence identity to the amino acid sequence of SEQ ID NO: 119. See Table 4.

In some embodiments, the antibody comprises a heavy chain variable domain having the amino acid sequence of SEQ ID NO: 118, and a light chain variable domain having the amino acid sequence of SEQ ID NO: 119. In some embodiments, the antibody comprises a heavy chain variable domain having at least 90% sequence identity to the amino acid sequence of SEQ ID NO: 118, and a light chain variable domain having at least 90% sequence identity to the amino acid sequence of SEQ ID NO: 119. See Table 4.

In some embodiments, the antibody comprises a heavy chain variable domain having the amino acid sequence of SEQ ID NO: 120. In some embodiments, the antibody comprises a heavy chain variable domain having at least 90% sequence identity to the amino acid sequence of SEQ ID NO: 120. See Table 4.

In some embodiments, the antibody comprises a light chain variable domain having the amino acid sequence of SEQ ID NO: 121. In some embodiments, the antibody comprises a light chain variable domain having at least 90% sequence identity to the amino acid sequence of SEQ ID NO: 121. See Table 4.

In some embodiments, the antibody comprises a heavy chain variable domain having the amino acid sequence of SEQ ID NO: 120, and a light chain variable domain having the amino acid sequence of SEQ ID NO: 121. In some embodiments, the antibody comprises a heavy chain variable domain having at least 90% sequence identity to the amino acid sequence of SEQ ID NO: 120, and a light chain variable domain having at least 90% sequence identity to the amino acid sequence of SEQ ID NO: 121. See Table 4.

In some embodiments, the antibody comprises a heavy chain variable domain having the amino acid sequence of SEQ ID NO: 122. In some embodiments, the antibody comprises a heavy chain variable domain having at least 90% sequence identity to the amino acid sequence of SEQ ID NO: 122. See Table 4.

In some embodiments, the antibody comprises a light chain variable domain having the amino acid sequence of SEQ ID NO: 123. In some embodiments, the antibody comprises a light chain variable domain having at least 90% sequence identity to the amino acid sequence of SEQ ID NO: 123. See Table 4.

In some embodiments, the antibody comprises a heavy chain variable domain having the amino acid sequence of SEQ ID NO: 122, and a light chain variable domain having the amino acid sequence of SEQ ID NO: 123. In some embodiments, the antibody comprises a heavy chain variable domain having at least 90% sequence identity to the amino acid sequence of SEQ ID NO: 122, and a light chain variable domain having at least 90% sequence identity to the amino acid sequence of SEQ ID NO: 123. See Table 4.

In some embodiments, the antibody comprises a heavy chain variable domain having the amino acid sequence of SEQ ID NO: 124. In some embodiments, the antibody comprises a heavy chain variable domain having at least 90% sequence identity to the amino acid sequence of SEQ ID NO: 124. See Table 4.

In some embodiments, the antibody comprises a light chain variable domain having the amino acid sequence of SEQ ID NO: 125. In some embodiments, the antibody comprises a light chain variable domain having at least 90% sequence identity to the amino acid sequence of SEQ ID NO: 125. See Table 4.

In some embodiments, the antibody comprises a heavy chain variable domain having the amino acid sequence of SEQ ID NO: 124, and a light chain variable domain having the amino acid sequence of SEQ ID NO: 125. In some embodiments, the antibody comprises a heavy chain variable domain having at least 90% sequence identity to the amino acid sequence of SEQ ID NO: 124, and a light chain variable domain having at least 90% sequence identity to the amino acid sequence of SEQ ID NO: 125. See Table 4.

In some embodiments, the antibody comprises a heavy chain variable domain having the amino acid sequence of SEQ ID NO: 126. In some embodiments, the antibody comprises a heavy chain variable domain having at least 90% sequence identity to the amino acid sequence of SEQ ID NO: 126. See Table 4.

In some embodiments, the antibody comprises a light chain variable domain having the amino acid sequence of SEQ ID NO: 127. In some embodiments, the antibody comprises a light chain variable domain having at least 90% sequence identity to the amino acid sequence of SEQ ID NO: 127. See Table 4.

In some embodiments, the antibody comprises a heavy chain variable domain having the amino acid sequence of SEQ ID NO: 126, and a light chain variable domain having the amino acid sequence of SEQ ID NO: 127. In some embodiments, the antibody comprises a heavy chain variable domain having at least 90% sequence identity to the amino acid sequence of SEQ ID NO: 126, and a light chain variable domain having at least 90% sequence identity to the amino acid sequence of SEQ ID NO: 127. See Table 4.

In some embodiments, the antibody comprises a heavy chain variable domain having the amino acid sequence of SEQ ID NO: 128. In some embodiments, the antibody comprises a heavy chain variable domain having at least 90% sequence identity to the amino acid sequence of SEQ ID NO: 128. See Table 4.

In some embodiments, the antibody comprises a light chain variable domain having the amino acid sequence of SEQ ID NO: 129. In some embodiments, the antibody comprises a light chain variable domain having at least 90% sequence identity to the amino acid sequence of SEQ ID NO: 129. See Table 4.

In some embodiments, the antibody comprises a heavy chain variable domain having the amino acid sequence of SEQ ID NO: 128, and a light chain variable domain having the amino acid sequence of SEQ ID NO: 129. In some embodiments, the antibody comprises a heavy chain variable domain having at least 90% sequence identity to the amino acid sequence of SEQ ID NO: 128, and a light chain variable domain having at least 90% sequence identity to the amino acid sequence of SEQ ID NO: 129. See Table 4.

In some embodiments, the antibody comprises a heavy chain variable domain having the amino acid sequence of SEQ ID NO: 130. In some embodiments, the antibody comprises a heavy chain variable domain having at least 90% sequence identity to the amino acid sequence of SEQ ID NO: 130. See Table 4.

In some embodiments, the antibody comprises a light chain variable domain having the amino acid sequence of SEQ ID NO: 131. In some embodiments, the antibody comprises a light chain variable domain having at least 90% sequence identity to the amino acid sequence of SEQ ID NO: 131. See Table 4.

In some embodiments, the antibody comprises a heavy chain variable domain having the amino acid sequence of SEQ ID NO: 130, and a light chain variable domain having the amino acid sequence of SEQ ID NO: 131. In some embodiments, the antibody comprises a heavy chain variable domain having at least 90% sequence identity to the amino acid sequence of SEQ ID NO: 130, and a light chain variable domain having at least 90% sequence identity to the amino acid sequence of SEQ ID NO: 131. See Table 4.

In some embodiments, the antibody comprises a heavy chain variable domain having the amino acid sequence of SEQ ID NO: 132. In some embodiments, the antibody comprises a heavy chain variable domain having at least 90% sequence identity to the amino acid sequence of SEQ ID NO: 132. See Table 4.

In some embodiments, the antibody comprises a light chain variable domain having the amino acid sequence of SEQ ID NO: 133. In some embodiments, the antibody comprises a light chain variable domain having at least 90% sequence identity to the amino acid sequence of SEQ ID NO: 133. See Table 4.

In some embodiments, the antibody comprises a heavy chain variable domain having the amino acid sequence of SEQ ID NO: 132, and a light chain variable domain having the amino acid sequence of SEQ ID NO: 133. In some embodiments, the antibody comprises a heavy chain variable domain having at least 90% sequence identity to the amino acid sequence of SEQ ID NO: 132, and a light chain variable domain having at least 90% sequence identity to the amino acid sequence of SEQ ID NO: 133. See Table 4.

In some embodiments, the antibody comprises a heavy chain variable domain having the amino acid sequence of SEQ ID NO: 134. In some embodiments, the antibody comprises a heavy chain variable domain having at least 90% sequence identity to the amino acid sequence of SEQ ID NO: 134. See Table 4.

In some embodiments, the antibody comprises a light chain variable domain having the amino acid sequence of SEQ ID NO: 135. In some embodiments, the antibody comprises a light chain variable domain having at least 90% sequence identity to the amino acid sequence of SEQ ID NO: 135. See Table 4.

In some embodiments, the antibody comprises a heavy chain variable domain having the amino acid sequence of SEQ ID NO: 134, and a light chain variable domain having the amino acid sequence of SEQ ID NO: 135. In some embodiments, the antibody comprises a heavy chain variable domain having at least 90% sequence identity to the amino acid sequence of SEQ ID NO: 134, and a light chain variable domain having at least 90% sequence identity to the amino acid sequence of SEQ ID NO: 135. See Table 4.

In some embodiments, the antibody comprises a heavy chain variable domain having the amino acid sequence of SEQ ID NO: 136. In some embodiments, the antibody comprises a heavy chain variable domain having at least 90% sequence identity to the amino acid sequence of SEQ ID NO: 136. See Table 4.

In some embodiments, the antibody comprises a light chain variable domain having the amino acid sequence of SEQ ID NO: 137. In some embodiments, the antibody comprises a light chain variable domain having at least 90% sequence identity to the amino acid sequence of SEQ ID NO: 137. See Table 4.

In some embodiments, the antibody comprises a heavy chain variable domain having the amino acid sequence of SEQ ID NO: 136, and a light chain variable domain having the amino acid sequence of SEQ ID NO: 137. In some embodiments, the antibody comprises a heavy chain variable domain having at least 90% sequence identity to the amino acid sequence of SEQ ID NO: 136, and a light chain variable domain having at least 90% sequence identity to the amino acid sequence of SEQ ID NO: 137. See Table 4.

In some embodiments, the antibody comprises a heavy chain variable domain having the amino acid sequence of SEQ ID NO: 138. In some embodiments, the antibody comprises a heavy chain variable domain having at least 90% sequence identity to the amino acid sequence of SEQ ID NO: 138. See Table 4.

In some embodiments, the antibody comprises a light chain variable domain having the amino acid sequence of SEQ ID NO: 139. In some embodiments, the antibody comprises a light chain variable domain having at least 90% sequence identity to the amino acid sequence of SEQ ID NO: 139. See Table 4.

In some embodiments, the antibody comprises a heavy chain variable domain having the amino acid sequence of SEQ ID NO: 138, and a light chain variable domain having the amino acid sequence of SEQ ID NO: 139. In some embodiments, the antibody comprises a heavy chain variable domain having at least 90% sequence identity to the amino acid sequence of SEQ ID NO: 138, and a light chain variable domain having at least 90% sequence identity to the amino acid sequence of SEQ ID NO: 139. See Table 4.

TABLE 4

Heavy chain and light chain variable domain amino acid sequences of additional anti-Factor D antibodies

| | | |
|---|---|---|
| SEQ ID NO: 102 | murine AFD Heavy Chain Variable Region | QVQLQQSGAELVKPGASVKLSCKASGYTFTSYYMYWVKERPGQGLEWIGEI NPTNGGTNFNEKFKSKATLTVDTSSNTAYMQLSSLTSEDSAVYYCAREGGF AYWGQGTLVTVSA |
| SEQ ID NO: 103 | murine AFD Light Chain Variable Region | DIVMTQSQKFMSTSVGDRVSVTCKASQNVDTDVAWFQQKPGQSPRGLIYSA SSRYSGVPDRFTGSGSGTDFTLTISNVQSEDLAEYFCQQYNNYPLTFGSGTK VEIK |
| SEQ ID NO: 104 | huAFD.v2.0 Heavy Chain Variable Region | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YWGQGTLVTVSS |
| SEQ ID NO: 105 | huAFD.v2.0 Light Chain Variable Region | DIQMTQSPSSLSASVGDRVTITCKASQNVDTDVAWFQQKPGKAPKGLIYSAS SRYSGVPSRFSGSGSGTDFTLTISSLQPEDFATYYCQQYNNYPLTFGQGTKVE IK |
| SEQ ID NO: 106 | huAFD.v2.1 Heavy Chain Variable Region | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YWGQGTLVTVSS |
| SEQ ID NO: 107 | huAFD.v2.1 Light Chain Variable Region | DIQMTQSPSSLSASVGDRVTITCKASQNVDTDVAWFQQKPGKAPKGLIRSAS SRYSGVPSRFSGSGSGTDFTLTISSLQPEDFATYYCQQYNNYPLTFGQGTKVE IK |
| SEQ ID NO: 108 | huAFD.v2.3 Heavy Chain Variable Region | EVQLVQSGAEVKKPGASVKVSCKASGYTFTSYYMYWVRQAPGQGLEWIGE INPYSGDTNFNEKFKSRATLTVDTSTSTAYLELSSLRSEDTAVYYCAREGGFA YWGQGTLVTVSS |
| SEQ ID NO: 109 | huAFD.v2.3 Light Chain Variable Region | DIQMTQSPSSLSASVGDRVTITCKASQNVDTDVAWFQQKPGKAPKGLIRSAS SRYSGVPSRFSGSGSGTDFTLTISSLQPEDFATYYCQQYNNYPLTFGQGTKVE IK |
| SEQ ID NO: 110 | huAFD.v1 Heavy Chain Variable Region | EVQLVQSGAEVKKPGASVKVSCKASGYTFTSYYMYWVRQAPGQGLEWIGE INPTNGGTNFNEKFKSRATLTVDTSTSTAYLELSSLRSEDTAVYYCAREGGF AYWGQGTLVTVSS |
| SEQ ID NO: 111 | huAFD.v1 Light Chain Variable Region | DIQMTQSPSSLSASVGDRVTITCKASQNVDTDVAWFQQKPGKAPKGLIYSAS SRYSGVPSRFSGSGSGTDFTLTISSLQPEDFATYYCQQYNNYPLTFGQGTKVE IK |
| SEQ ID NO: 112 | huAFD.v1.1 Heavy Chain Variable Region | EVQLVQSGAEVKKPGASVKVSCKASGYTFTSYYMYWVRQAPGQGLEWIGE INPTQGGTNFNEKFKSRATLTVDTSTSTAYLELSSLRSEDTAVYYCAREGGF AYWGQGTLVTVSS |
| SEQ ID NO: 113 | huAFD.v1.1 Light Chain Variable Region | DIQMTQSPSSLSASVGDRVTITCKASQNVDTDVAWFQQKPGKAPKGLIYSAS SRYSGVPSRFSGSGSGTDFTLTISSLQPEDFATYYCQQYNNYPLTFGQGTKVE IK |
| SEQ ID NO: 114 | huAFD.v2.2 Heavy Chain Variable Region | EVQLVQSGAEVKKPGASVKVSCKASGYTFTSYYMYWVRQAPGQGLEWIGE INPTSGDTNFNEKFKSRATLTVDTSTSTAYLELSSLRSEDTAVYYCAREGGFA YWGQGTLVTVSS |
| SEQ ID NO: 115 | huAFD.v2.2 Light Chain Variable Region | DIQMTQSPSSLSASVGDRVTITCKASQNVDTDVAWFQQKPGKAPKGLIYSAS SRYSGVPSRFSGSGSGTDFTLTISSLQPEDFATYYCQQYNNYPLTFGQGTKVE IK |
| SEQ ID NO: 116 | huAFD.v2.4 Heavy Chain Variable Region | EVQLVQSGAEVKKPGASVKVSCKASGYTFTSYYMYWVRQAPGQGLEWIGE INPTSGETNFNEKFKSRATLTVDTSTSTAYLELSSLRSEDTAVYYCAREGGFA YWGQGTLVTVSS |
| SEQ ID NO: 117 | huAFD.v2.4 Light Chain Variable Region | DIQMTQSPSSLSASVGDRVTITCKASQNVDTDVAWFQQKPGKAPKGLIYSAS SRYSGVPSRFSGSGSGTDFTLTISSLQPEDFATYYCQQYNNYPLTFGQGTKVE IK |

TABLE 4-continued

Heavy chain and light chain variable domain amino acid sequences of additional anti-Factor D antibodies

| SEQ ID NO: 118 | huAFD.v2.5 Heavy Chain Variable Region | EVQLVQSGAEVKKPGASVKVSCKASGYTFTSYYMYWVRQAPGQGLEWIGE INPYSGGTNFNEKFKSRATLTVDTSTSTAYLELSSLRSEDTAVYYCAREGGFA YWGQGTLVTVSS |
|---|---|---|
| SEQ ID NO: 119 | huAFD.v2.5 Light Chain Variable Region | DIQMTQSPSSLSASVGDRVTITCKASQNVDTDVAWFQQKPGKAPKGLIYSAS SRYSGVPSRFSGSGSGTDFTLTISSLQPEDFATYYCQQYNNYPLTFGQGTKVE IK |
| SEQ ID NO: 120 | huAFD.v2.6 Heavy Chain Variable Region | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YWGQGTLVTVSS |
| SEQ ID NO: 121 | huAFD.v2.6 Light Chain Variable Region | DIQMTQSPSSLSASVGDRVTITCKASQNVDTDVAWFQQKPGKAPKGLISSAS SRYSGVPSRFSGSGSGTDFTLTISSLQPEDFATYYCQQYNNYPLTFGQGTKVE IK |
| SEQ ID NO: 122 | huAFD.v2.7 Heavy Chain Variable Region | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YWGQGTLVTVSS |
| SEQ ID NO: 123 | huAFD.v2.7 Light Chain Variable Region | DIQMTQSPSSLSASVGDRVTITCKASQNVDTDVAWFQQKPGKAPKGLIKSAS SRYSGVPSRFSGSGSGTDFTLTISSLQPEDFATYYCQQYNNYPLTFGQGTKVE IK |
| SEQ ID NO: 124 | huAFD.v2.8 Heavy Chain Variable Region | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YWGQGTLVTVSS |
| SEQ ID NO: 125 | huAFD.v2.8 Light Chain Variable Region | DIQMTQSPSSLSASVGDRVTITCKASQNVDTDVAWFQQKPGKAPKGLIQSAS SRYSGVPSRFSGSGSGTDFTLTISSLQPEDFATYYCQQYNNYPLTFGQGTKVE IK |
| SEQ ID NO: 126 | huAFD.v2.9 Heavy Chain Variable Region | EVQLVQSGAEVKKPGASVKVSCKASGYTFTSYYMYWVRQAPGQGLEWIG WINPTSGGTNFNEKFKSRATLTVDTSTSTAYLELSSLRSEDTAVYYCAREGG FAYWGQGTLVTVSS |
| SEQ ID NO: 127 | huAFD.v2.9 Light Chain Variable Region | DIQMTQSPSSLSASVGDRVTITCKASQNVDTDVAWFQQKPGKAPKGLIYSAS SRYSGVPSRFSGSGSGTDFTLTISSLQPEDFATYYCQQYNNYPLTFGQGTKVE IK |
| SEQ ID NO: 128 | huAFD.v2.10 Heavy Chain Variable Region | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YWGQGTLVTVSS |
| SEQ ID NO: 129 | huAFD.v2.10 Light Chain Variable Region | DIQMTQSPSSLSASVGDRVTITCKASQNVDTDVAWFQQKPGKAPKGLIYSAS SRKSGVPSRFSGSGSGTDFTLTISSLQPEDFATYYCQQYNNYPLTFGQGTKVE IK |
| SEQ ID NO: 130 | huAFD.v2.11 Heavy Chain Variable Region | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YWGQGTLVTVSS |
| SEQ ID NO: 131 | huAFD.v2.11 Light Chain Variable Region | DIQMTQSPSSLSASVGDRVTITCKASQNVDTDVAWFQQKPGKAPKGLIYSAS SRRSGVPSRFSGSGSGTDFTLTISSLQPEDFATYYCQQYNNYPLTFGQGTKVE IK |
| SEQ ID NO: 132 | huAFD.v2.12 Heavy Chain Variable Region | EVQLVQSGAEVKKPGASVKVSCKASGYTFTSYYMYWVRQAPGQGLEWIGE INPYSGGTNFNEKFKSRATLTVDTSTSTAYLELSSLRSEDTAVYYCAREGGFA YWGQGTLVTVSS |
| SEQ ID NO: 133 | huAFD.v2.12 Light Chain Variable Region | DIQMTQSPSSLSASVGDRVTITCKASQNVDTDVAWFQQKPGKAPKGLIRSAS SRYSGVPSRFSGSGSGTDFTLTISSLQPEDFATYYCQQYNNYPLTFGQGTKVE IK |
| SEQ ID NO: 134 | huAFD.v2.13 Heavy Chain Variable Region | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YWGQGTLVTVSS |
| SEQ ID NO: 135 | huAFD.v2.13 Light Chain Variable Region | DIQMTQSPSSLSASVGDRVTITCKASQNVDTDVAWFQQKPGKAPKGLIRSAS SRYSGVPSRFSGSGSGTDFTLTISSLQPEDFATYYCQQYENYPLTFGQGTKVE IK |
| SEQ ID NO: 136 | huAFD.v2.14 Heavy Chain Variable Region | EVQLVQSGAEVKKPGASVKVSCKASGYTFTSYYMYWVRQAPGQGLEWIGE INPTSGETNFNEKFKSRATLTVDTSTSTAYLELSSLRSEDTAVYYCAREGGFA YWGQGTLVTVSS |

TABLE 4-continued

Heavy chain and light chain variable domain amino acid sequences of additional anti-Factor D antibodies

| SEQ ID NO: 137 | huAFD.v2.14 Light Chain Variable Region | DIQMTQSPSSLSASVGDRVTITCKASQNVDTDVAWFQQKPGKAPKGLIRSAS SRYSGVPSRFSGSGSGTDFTLTISSLQPEDFATYYCQQYNNYPLTFGQGTKVE IK |
|---|---|---|
| SEQ ID NO: 138 | huAFD.v2.15 Heavy Chain Variable Region | EVQLVQSGAEVKKPGASVKVSCKASGYTFTSYYMYWVRQAPGQGLEWIGE INPYSGETNFNEKFKSRATLTVDTSTSTAYLELSSLRSEDTAVYYCAREGGFA YWGQGTLVTVSS |
| SEQ ID NO: 139 | huAFD.v2.15 Light Chain Variable Region | DIQMTQSPSSLSASVGDRVTITCKASQNVDTDVAWFQQKPGKAPKGLIRSAS SRYSGVPSRFSGSGSGTDFTLTISSLQPEDFATYYCQQYNNYPLTFGQGTKVE IK |

In some embodiments, the antibody comprises a heavy chain having the amino acid sequence of SEQ ID NO: 53. In some embodiments, the antibody comprises a heavy chain having at least 90% sequence identity to the amino acid sequence of SEQ ID NO: 53. See Table 5.

In some embodiments, the antibody comprises a light chain having the amino acid sequence of SEQ ID NO: 54. In some embodiments, the antibody comprises a light chain having at least 90% sequence identity to the amino acid sequence of SEQ ID NO: 54. See Table 5.

In some embodiments, the antibody comprises a heavy chain having the amino acid sequence of SEQ ID NO: 53, and a light chain having the amino acid sequence of SEQ ID NO: 54. In some embodiments, the antibody comprises a heavy chain having at least 90% sequence identity to the amino acid sequence of SEQ ID NO: 53, and a light chain having at least 90% sequence identity to the amino acid sequence of SEQ ID NO: 54. See Table 5.

In some embodiments, the antibody comprises a heavy chain having the amino acid sequence of SEQ ID NO: 55. In some embodiments, the antibody comprises a heavy chain having at least 90% sequence identity to the amino acid sequence of SEQ ID NO: 55. See Table 5.

In some embodiments, the antibody comprises a light chain having the amino acid sequence of SEQ ID NO: 56. In some embodiments, the antibody comprises a light chain having at least 90% sequence identity to the amino acid sequence of SEQ ID NO: 56. See Table 5.

In some embodiments, the antibody comprises a heavy chain having the amino acid sequence of SEQ ID NO: 55, and a light chain having the amino acid sequence of SEQ ID NO: 56. In some embodiments, the antibody comprises a heavy chain having at least 90% sequence identity to the amino acid sequence of SEQ ID NO: 55, and a light chain having at least 90% sequence identity to the amino acid sequence of SEQ ID NO: 56. See Table 5.

In some embodiments, the antibody comprises a heavy chain having the amino acid sequence of SEQ ID NO: 57. In some embodiments, the antibody comprises a heavy chain having at least 90% sequence identity to the amino acid sequence of SEQ ID NO: 57. See Table 5.

In some embodiments, the antibody comprises a light chain having the amino acid sequence of SEQ ID NO: 58. In some embodiments, the antibody comprises a light chain having at least 90% sequence identity to the amino acid sequence of SEQ ID NO: 58. See Table 5.

In some embodiments, the antibody comprises a heavy chain having the amino acid sequence of SEQ ID NO: 57, and a light chain having the amino acid sequence of SEQ ID NO: 58. In some embodiments, the antibody comprises a heavy chain having at least 90% sequence identity to the amino acid sequence of SEQ ID NO: 57, and a light chain having at least 90% sequence identity to the amino acid sequence of SEQ ID NO: 58. See Table 5.

In some embodiments, the antibody comprises a heavy chain having the amino acid sequence of SEQ ID NO: 59. In some embodiments, the antibody comprises a heavy chain having at least 90% sequence identity to the amino acid sequence of SEQ ID NO: 59. See Table 5.

In some embodiments, the antibody comprises a light chain having the amino acid sequence of SEQ ID NO: 60. In some embodiments, the antibody comprises a light chain having at least 90% sequence identity to the amino acid sequence of SEQ ID NO: 60. See Table 5.

In some embodiments, the antibody comprises a heavy chain having the amino acid sequence of SEQ ID NO: 59, and a light chain having the amino acid sequence of SEQ ID NO: 60. In some embodiments, the antibody comprises a heavy chain having at least 90% sequence identity to the amino acid sequence of SEQ ID NO: 59, and a light chain having at least 90% sequence identity to the amino acid sequence of SEQ ID NO: 60. See Table 5.

In some embodiments, the antibody comprises a heavy chain having the amino acid sequence of SEQ ID NO: 61. In some embodiments, the antibody comprises a heavy chain having at least 90% sequence identity to the amino acid sequence of SEQ ID NO: 61. See Table 5.

In some embodiments, the antibody comprises a light chain having the amino acid sequence of SEQ ID NO: 62. In some embodiments, the antibody comprises a light chain having at least 90% sequence identity to the amino acid sequence of SEQ ID NO: 62. See Table 5.

In some embodiments, the antibody comprises a heavy chain having the amino acid sequence of SEQ ID NO: 61, and a light chain having the amino acid sequence of SEQ ID NO: 62. In some embodiments, the antibody comprises a heavy chain having at least 90% sequence identity to the amino acid sequence of SEQ ID NO: 61, and a light chain having at least 90% sequence identity to the amino acid sequence of SEQ ID NO: 62. See Table 5.

In some embodiments, the antibody comprises a heavy chain having the amino acid sequence of SEQ ID NO: 63. In some embodiments, the antibody comprises a heavy chain having at least 90% sequence identity to the amino acid sequence of SEQ ID NO: 63. See Table 5.

In some embodiments, the antibody comprises a light chain having the amino acid sequence of SEQ ID NO: 64. In some embodiments, the antibody comprises a light chain having at least 90% sequence identity to the amino acid sequence of SEQ ID NO: 64. See Table 5.

In some embodiments, the antibody comprises a heavy chain having the amino acid sequence of SEQ ID NO: 63, and a light chain having the amino acid sequence of SEQ ID NO: 64. In some embodiments, the antibody comprises a heavy chain having at least 90% sequence identity to the amino acid sequence of SEQ ID NO: 63, and a light chain having at least 90% sequence identity to the amino acid sequence of SEQ ID NO: 64. See Table 5.

In some embodiments, the antibody comprises a heavy chain having the amino acid sequence of SEQ ID NO: 65. In some embodiments, the antibody comprises a heavy chain having at least 90% sequence identity to the amino acid sequence of SEQ ID NO: 65. See Table 5.

In some embodiments, the antibody comprises a light chain having the amino acid sequence of SEQ ID NO: 66. In some embodiments, the antibody comprises a light chain having at least 90% sequence identity to the amino acid sequence of SEQ ID NO: 66. See Table 5.

In some embodiments, the antibody comprises a heavy chain having the amino acid sequence of SEQ ID NO: 65, and a light chain having the amino acid sequence of SEQ ID NO: 66. In some embodiments, the antibody comprises a heavy chain having at least 90% sequence identity to the amino acid sequence of SEQ ID NO: 65, and a light chain having at least 90% sequence identity to the amino acid sequence of SEQ ID NO: 66. See Table 5.

In some embodiments, the antibody comprises a heavy chain having the amino acid sequence of SEQ ID NO: 67. In some embodiments, the antibody comprises a heavy chain having at least 90% sequence identity to the amino acid sequence of SEQ ID NO: 67. See Table 5.

In some embodiments, the antibody comprises a light chain having the amino acid sequence of SEQ ID NO: 68. In some embodiments, the antibody comprises a light chain having at least 90% sequence identity to the amino acid sequence of SEQ ID NO: 68. See Table 5.

In some embodiments, the antibody comprises a heavy chain having the amino acid sequence of SEQ ID NO: 67, and a light chain having the amino acid sequence of SEQ ID NO: 68. In some embodiments, the antibody comprises a heavy chain having at least 90% sequence identity to the amino acid sequence of SEQ ID NO: 67, and a light chain having at least 90% sequence identity to the amino acid sequence of SEQ ID NO: 68. See Table 5.

In some embodiments, the antibody comprises a heavy chain having the amino acid sequence of SEQ ID NO: 69. In some embodiments, the antibody comprises a heavy chain having at least 90% sequence identity to the amino acid sequence of SEQ ID NO: 69. See Table 5.

In some embodiments, the antibody comprises a light chain having the amino acid sequence of SEQ ID NO: 70. In some embodiments, the antibody comprises a light chain having at least 90% sequence identity to the amino acid sequence of SEQ ID NO: 70. See Table 5.

In some embodiments, the antibody comprises a heavy chain having the amino acid sequence of SEQ ID NO: 69, and a light chain having the amino acid sequence of SEQ ID NO: 70. In some embodiments, the antibody comprises a heavy chain having at least 90% sequence identity to the amino acid sequence of SEQ ID NO: 69, and a light chain having at least 90% sequence identity to the amino acid sequence of SEQ ID NO: 70. See Table 5.

In some embodiments, the antibody comprises a heavy chain having the amino acid sequence of SEQ ID NO: 71. In some embodiments, the antibody comprises a heavy chain having at least 90% sequence identity to the amino acid sequence of SEQ ID NO: 71. See Table 5.

In some embodiments, the antibody comprises a light chain having the amino acid sequence of SEQ ID NO: 72. In some embodiments, the antibody comprises a light chain having at least 90% sequence identity to the amino acid sequence of SEQ ID NO: 72. See Table 5.

In some embodiments, the antibody comprises a heavy chain having the amino acid sequence of SEQ ID NO: 71, and a light chain having the amino acid sequence of SEQ ID NO: 72. In some embodiments, the antibody comprises a heavy chain having at least 90% sequence identity to the amino acid sequence of SEQ ID NO: 71, and a light chain having at least 90% sequence identity to the amino acid sequence of SEQ ID NO: 72. See Table 5.

In some embodiments, the antibody comprises a heavy chain having the amino acid sequence of SEQ ID NO: 73. In some embodiments, the antibody comprises a heavy chain having at least 90% sequence identity to the amino acid sequence of SEQ ID NO: 73. See Table 5.

In some embodiments, the antibody comprises a light chain having the amino acid sequence of SEQ ID NO: 74. In some embodiments, the antibody comprises a light chain having at least 90% sequence identity to the amino acid sequence of SEQ ID NO: 74. See Table 5.

In some embodiments, the antibody comprises a heavy chain having the amino acid sequence of SEQ ID NO: 73, and a light chain having the amino acid sequence of SEQ ID NO: 74. In some embodiments, the antibody comprises a heavy chain having at least 90% sequence identity to the amino acid sequence of SEQ ID NO: 73, and a light chain having at least 90% sequence identity to the amino acid sequence of SEQ ID NO: 74. See Table 5.

In some embodiments, the antibody comprises a heavy chain having the amino acid sequence of SEQ ID NO: 75. In some embodiments, the antibody comprises a heavy chain having at least 90% sequence identity to the amino acid sequence of SEQ ID NO: 75. See Table 5.

In some embodiments, the antibody comprises a light chain having the amino acid sequence of SEQ ID NO: 76. In some embodiments, the antibody comprises a light chain having at least 90% sequence identity to the amino acid sequence of SEQ ID NO: 76. See Table 5.

In some embodiments, the antibody comprises a heavy chain having the amino acid sequence of SEQ ID NO: 75, and a light chain having the amino acid sequence of SEQ ID NO: 76. In some embodiments, the antibody comprises a heavy chain having at least 90% sequence identity to the amino acid sequence of SEQ ID NO: 75, and a light chain having at least 90% sequence identity to the amino acid sequence of SEQ ID NO: 76. See Table 5.

In some embodiments, the antibody comprises a heavy chain having the amino acid sequence of SEQ ID NO: 77. In some embodiments, the antibody comprises a heavy chain having at least 90% sequence identity to the amino acid sequence of SEQ ID NO: 77. See Table 5.

In some embodiments, the antibody comprises a light chain having the amino acid sequence of SEQ ID NO: 78. In some embodiments, the antibody comprises a light chain having at least 90% sequence identity to the amino acid sequence of SEQ ID NO: 78. See Table 5.

In some embodiments, the antibody comprises a heavy chain having the amino acid sequence of SEQ ID NO: 77, and a light chain having the amino acid sequence of SEQ ID NO: 78. In some embodiments, the antibody comprises a heavy chain having at least 90% sequence identity to the amino acid sequence of SEQ ID NO: 77, and a light chain having at least 90% sequence identity to the amino acid sequence of SEQ ID NO: 78. See Table 5.

In some embodiments, the antibody comprises a heavy chain having the amino acid sequence of SEQ ID NO: 79. In some embodiments, the antibody comprises a heavy chain having at least 90% sequence identity to the amino acid sequence of SEQ ID NO: 79. See Table 5.

In some embodiments, the antibody comprises a light chain having the amino acid sequence of SEQ ID NO: 80. In some embodiments, the antibody comprises a light chain having at least 90% sequence identity to the amino acid sequence of SEQ ID NO: 80. See Table 5.

In some embodiments, the antibody comprises a heavy chain having the amino acid sequence of SEQ ID NO: 79, and a light chain having the amino acid sequence of SEQ ID NO: 80. In some embodiments, the antibody comprises a heavy chain having at least 90% sequence identity to the amino acid sequence of SEQ ID NO: 79, and a light chain having at least 90% sequence identity to the amino acid sequence of SEQ ID NO: 80. See Table 5.

In some embodiments, the antibody comprises a heavy chain having the amino acid sequence of SEQ ID NO: 81. In some embodiments, the antibody comprises a heavy chain having at least 90% sequence identity to the amino acid sequence of SEQ ID NO: 81. See Table 5.

In some embodiments, the antibody comprises a light chain having the amino acid sequence of SEQ ID NO: 82. In some embodiments, the antibody comprises a light chain having at least 90% sequence identity to the amino acid sequence of SEQ ID NO: 82. See Table 5.

In some embodiments, the antibody comprises a heavy chain having the amino acid sequence of SEQ ID NO: 81, and a light chain having the amino acid sequence of SEQ ID NO: 82. In some embodiments, the antibody comprises a heavy chain having at least 90% sequence identity to the amino acid sequence of SEQ ID NO: 81, and a light chain having at least 90% sequence identity to the amino acid sequence of SEQ ID NO: 82. See Table 5.

In some embodiments, the antibody comprises a heavy chain having the amino acid sequence of SEQ ID NO: 83. In some embodiments, the antibody comprises a heavy chain having at least 90% sequence identity to the amino acid sequence of SEQ ID NO: 83. See Table 5.

In some embodiments, the antibody comprises a light chain having the amino acid sequence of SEQ ID NO: 84. In some embodiments, the antibody comprises a light chain having at least 90% sequence identity to the amino acid sequence of SEQ ID NO: 84. See Table 5.

In some embodiments, the antibody comprises a heavy chain having the amino acid sequence of SEQ ID NO: 83, and a light chain having the amino acid sequence of SEQ ID NO: 84. In some embodiments, the antibody comprises a heavy chain having at least 90% sequence identity to the amino acid sequence of SEQ ID NO: 83, and a light chain having at least 90% sequence identity to the amino acid sequence of SEQ ID NO: 84. See Table 5.

TABLE 5

Heavy chain and light chain amino acid sequences of anti-Factor D antibodies

| | | |
|---|---|---|
| SEQ ID NO: 53 | AFD WT Heavy Chain | EVQLVQSGPELKKPGASVKVSCKASGYTFTNYGMNWVRQAPGQGLEWMG WINTYTGETTYADDFKGRFVFSLDTSVSTAYLQISSLKAEDTAVYYCEREGG VNNWGQGTLVTVSSATKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKSCDKTHT |
| SEQ ID NO: 54 | AFD WT Light Chain | DIQVTQSPSSLSASVGDRVTITCITSTDIDDDMNWYQQKPGKVPKLLISGGNT LRPGVPSRFSGSGSGTDFTLTISSLQPEDVATYYCLQSDSLPYTFGQGTKVEIK RTVAAPSVFIFPPSDEQLKSGTASVVCLLNNFYPREAKVQWKVDNALQSGN SQESVIEQDSKDSTYSLSSTLTLSKADYEKHKVYACEVTHQGLSSPVTKSFN RGEC |
| SEQ ID NO: 55 | AFD.v1 Heavy Chain | EVQLVQSGPELKKPGASVKVSCKASGYTFTNYGMNWVRQAPGQGLEWMG WINTYTGETTYADDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKSCDKTHT |
| SEQ ID NO: 56 | AFD.v1 Light Chain | DIQVTQSPSSLSASVGDRVTITCITSTSIDDDMNWYQQKPGKVPKLLISGGNT LRPGVPSRFSGSGSGTDFTLTISSLQPEDVATYYCLQSDSLPYTFGQGTKVEIK RTVAAPSVFIFPPSDEQLKSGTASVVCLLNNFYPREAKVQWKVDNALQSGN SQESVIEQDSKDSTYSLSSTLTLSKADYEKHKVYACEVTHQGLSSPVTKSFN RGEC |
| SEQ ID NO: 57 | AFD.v2 Heavy Chain | EVQLVQSGPELKKPGASVKVSCKASGYTFTNYGMNWVRQAPGQGLEWMG WINTYTGETTYADDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKSCDKTHT |
| SEQ ID NO: 58 | AFD.v2 Light Chain | DIQVTQSPSSLSASVGDRVTITCITSTDIEDDMNWYQQKPGKVPKLLISGGNT LRPGVPSRFSGSGSGTDFTLTISSLQPEDVATYYCLQSDSLPYTFGQGTKVEIK RTVAAPSVFIFPPSDEQLKSGTASVVCLLNNFYPREAKVQWKVDNALQSGN SQESVIEQDSKDSTYSLSSTLTLSKADYEKHKVYACEVTHQGLSSPVTKSFN RGEC |

TABLE 5-continued

Heavy chain and light chain amino acid sequences of anti-Factor D antibodies

| SEQ ID NO: 59 | AFD.v3 Heavy Chain | EVQLVQSGPELKKPGASVKVSCKASGYTFTNYGMNWVRQAPGQGLEWMG WINTYTGETTYADDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKSCDKTHT |
|---|---|---|
| SEQ ID NO: 60 | AFD.v3 Light Chain | DIQVTQSPSSLSASVGDRVTITCITSTDIDSDMNWYQQKPGKVPKLLISGGNT LRPGVPSRFSGSGSGTDFTLTISSLQPEDVATYYCLQSDSLPYTFGQGTKVEIK RTVAAPSVFIFPPSDEQLKSGTASVVCLLNNFYPREAKVQWKVDNALQSGN SQESVTEQDSKDSTYSLSSTLTLSKADYEKHKVYACEVTHQGLSSPVTKSFN RGEC |
| SEQ ID NO: 61 | AFD.v4 Heavy Chain | EVQLVQSGPELKKPGASVKVSCKASGYTFTNYGMNWVRQAPGQGLEWMG WINTYTGETTYADDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKSCDKTHT |
| SEQ ID NO: 62 | AFD.v4 Light Chain | DIQVTQSPSSLSASVGDRVTITCITSTDIDDSMNWYQQKPGKVPKLLISGGNT LRPGVPSRFSGSGSGTDFTLTISSLQPEDVATYYCLQSDSLPYTFGQGTKVEIK RTVAAPSVFIFPPSDEQLKSGTASVVCLLNNFYPREAKVQWKVDNALQSGN SQESVTEQDSKDSTYSLSSTLTLSKADYEKHKVYACEVTHQGLSSPVTKSFN RGEC |
| SEQ ID NO: 63 | AFD.v5 Heavy Chain | EVQLVQSGPELKKPGASVKVSCKASGYTFTNYGMNWVRQAPGQGLEWMG WINTYTGETTYADDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKSCDKTHT |
| SEQ ID NO: 64 | AFD.v5 Light Chain | DIQVTQSPSSLSASVGDRVTITCITSTSIDSSMNWYQQKPGKVPKLLISGGNTL RPGVPSRFSGSGSGTDFTLTISSLQPEDVATYYCLQSDSLPYTFGQGTKVEIK RTVAAPSVFIFPPSDEQLKSGTASVVCLLNNFYPREAKVQWKVDNALQSGN SQESVTEQDSKDSTYSLSSTLTLSKADYEKHKVYACEVTHQGLSSPVTKSFN RGEC |
| SEQ ID NO: 65 | AFD.v6 Heavy Chain | EVQLVQSGPELKKPGASVKVSCKASGYTFTNYGMNWVRQAPGQGLEWMG WINTYTGETTYAEDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKSCDKTHT |
| SEQ ID NO: 66 | AFD.v6 Light Chain | DIQVTQSPSSLSASVGDRVTITCITSTDIESDMNWYQQKPGKVPKLLISGGNT LRPGVPSRFSGSGSGTDFTLTISSLQPEDVATYYCLQSDSLPYTFGQGTKVEIK RTVAAPSVFIFPPSDEQLKSGTASVVCLLNNFYPREAKVQWKVDNALQSGN SQESVTEQDSKDSTYSLSSTLTLSKADYEKHKVYACEVTHQGLSSPVTKSFN RGEC |
| SEQ ID NO: 67 | AFD.v7 Heavy Chain | EVQLVQSGPELKKPGASVKVSCKASGYTFTNYGMNWVRQAPGQGLEWMG WINTYTGETTYAEDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKSCDKTHT |
| SEQ ID NO: 68 | AFD.v7 Light Chain | DIQVTQSPSSLSASVGDRVTITCITSTDIESDMNWYQQKPGKVPKLLISGGNT LRPGVPSRFSGSGSGTDFTLTISSLQPEDVATYYCLQSESLPYTFGQGTKVEIK RTVAAPSVFIFPPSDEQLKSGTASVVCLLNNFYPREAKVQWKVDNALQSGN SQESVTEQDSKDSTYSLSSTLTLSKADYEKHKVYACEVTHQGLSSPVTKSFN RGEC |
| SEQ ID NO: 69 | AFD.v8 Heavy Chain | EVQLVQSGPELKKPGASVKVSCKASGYTFTNYGMNWVRQAPGQGLEWMG WINTYTGETTYAEDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKSCDKTHT |
| SEQ ID NO: 70 | AFD.v8 Light Chain | DIQVTQSPSSLSASVGDRVTITCITSTSIESDMNWYQQKPGKVPKLLISGGNTL RPGVPSRFSGSGSGTDFTLTISSLQPEDVATYYCLQSDSLPYTFGQGTKVEIK RTVAAPSVFIFPPSDEQLKSGTASVVCLLNNFYPREAKVQWKVDNALQSGN SQESVTEQDSKDSTYSLSSTLTLSKADYEKHKVYACEVTHQGLSSPVTKSFN RGEC |
| SEQ ID NO: 71 | AFD.v9 Heavy Chain | EVQLVQSGPELKKPGASVKVSCKASGYTFTNYGMNWVRQAPGQGLEWMG WINTYTGETTYAEDFKGRFVFSLDTSVSTAYLQISSLKAEDTAVYYCEREGG |

TABLE 5-continued

Heavy chain and light chain amino acid sequences of anti-Factor D antibodies

| | | |
|---|---|---|
| | | VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKSCDKTHT |
| SEQ ID NO: 72 | AFD.v9 Light Chain | DIQVTQSPSSLSASVGDRVTITCITSTSIESDMSWYQQKPGKVPKLLISGGNTL RPGVPSRFSGSGSGTDFTLTISSLQPEDVATYYCLQSDSLPYTFGQGTKVEIK RTVAAPSVFIFPPSDEQLKSGTASVVCLLNNFYPREAKVQWKVDNALQSGN SQESVIEQDSKDSTYSLSSTLTLSKADYEKHKVYACEVTHQGLSSPVTKSFN RGEC |
| SEQ ID NO: 73 | AFD.v10 Heavy Chain | EVQLVQSGPELKKPGASVKVSCKASGYTFTNYGMNWVRQAPGQGLEWMG WINTYTGETTYAEDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKSCDKTHT |
| SEQ ID NO: 74 | AFD.v10 Light Chain | DIQVTQSPSSLSASVGDRVTITCITSTSIESDMNWYQQKPGKVPKLLISGGNTL RPGVPSRFSGSGSGTDFTLTISSLQPEDVATYYCLQSESLPYTFGQGTKVEIKR TVAAPSVFIFPPSDEQLKSGTASVVCLLNNFYPREAKVQWKVDNALQSGNS QESVTEQDSKDSTYSLSSTLTLSKADYEKHKVYACEVTHQGLSSPVTKSFNR GEC |
| SEQ ID NO: 75 | AFD.v11 Heavy Chain | EVQLVQSGPELKKPGASVKVSCKASGYTFTNYGMNWVRQAPGQGLEWMG WISTYTGETTYAEDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKSCDKTHT |
| SEQ ID NO: 76 | AFD.v11 Light Chain | DIQVTQSPSSLSASVGDRVTITCITSTSIESDMNWYQQKPGKVPKLLISGGNTL RPGVPSRFSGSGSGTDFTLTISSLQPEDVATYYCLQSDSLPYTFGQGTKVEIK RTVAAPSVFIFPPSDEQLKSGTASVVCLLNNFYPREAKVQWKVDNALQSGN SQESVIEQDSKDSTYSLSSTLTLSKADYEKHKVYACEVTHQGLSSPVTKSFN RGEC |
| SEQ ID NO: 77 | AFD.v12 Heavy Chain | EVQLVQSGPELKKPGASVKVSCKASGYTFTNYGMNWVRQAPGQGLEWMG WINTYTGETTYAEDFKGRFVFSLDTSVSTAYLQISSLKAEDTAVYYCEREGG VDNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKSCDKTHT |
| SEQ ID NO: 78 | AFD.v12 Light Chain | DIQVTQSPSSLSASVGDRVTITCITSTSIESDMNWYQQKPGKVPKLLISGGNTL RPGVPSRFSGSGSGTDFTLTISSLQPEDVATYYCLQSDSLPYTFGQGTKVEIK RTVAAPSVFIFPPSDEQLKSGTASVVCLLNNFYPREAKVQWKVDNALQSGN SQESVIEQDSKDSTYSLSSTLTLSKADYEKHKVYACEVTHQGLSSPVTKSFN RGEC |
| SEQ ID NO: 79 | AFD.v13 Heavy Chain | EVQLVQSGPELKKPGASVKVSCKASGYTFTNYGMNWVRQAPGQGLEWMG WINTYTGETTYAEDFKGRFVFSLDTSVSTAYLQISSLKAEDTAVYYCEREGG VQNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKSCDKTHT |
| SEQ ID NO: 80 | AFD.v13 Light Chain | DIQVTQSPSSLSASVGDRVTITCITSTSIESDMNWYQQKPGKVPKLLISGGNTL RPGVPSRFSGSGSGTDFTLTISSLQPEDVATYYCLQSDSLPYTFGQGTKVEIK RTVAAPSVFIFPPSDEQLKSGTASVVCLLNNFYPREAKVQWKVDNALQSGN SQESVIEQDSKDSTYSLSSTLTLSKADYEKHKVYACEVTHQGLSSPVTKSFN RGEC |
| SEQ ID NO: 81 | AFD.v14 Heavy Chain | EVQLVQSGPELKKPGASVKVSCKASGYTFTNYGMNWVRQAPGQGLEWMG WINTYTGETTYAEDFKGRFVFSLDTSVSTAYLQISSLKAEDTAVYYCEREGG VSNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKSCDKTHT |
| SEQ ID NO: 82 | AFD.v14 Light Chain | DIQVTQSPSSLSASVGDRVTITCITSTSIESDMNWYQQKPGKVPKLLISGGNTL RPGVPSRFSGSGSGTDFTLTISSLQPEDVATYYCLQSDSLPYTFGQGTKVEIK RTVAAPSVFIFPPSDEQLKSGTASVVCLLNNFYPREAKVQWKVDNALQSGN SQESVIEQDSKDSTYSLSSTLTLSKADYEKHKVYACEVTHQGLSSPVTKSFN RGEC |
| SEQ ID NO: 83 | AFD.v15 Heavy Chain | EVQLVQSGPELKKPGASVKVSCKASGYTFTNYGMNWVRQAPGQGLEWMG WINTYTGETTYAEDFKGRFVFSLDTSVSTAYLQISSLKAEDTAVYYCEREGG VSNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKSCDKTHT |

TABLE 5-continued

Heavy chain and light chain amino acid sequences of anti-Factor D antibodies

| | | |
|---|---|---|
| SEQ ID NO: 84 | AFD.v15 Light Chain | DIQVTQSPSSLSASVGDRVTITCITSTSIESDMNWYQQKPGKVPKLLISGGNTL RPGVPSRFSGSGSGTDFTLTISSLQPEDVATYYCLQSESLPYTFGQGTKVEIKR TVAAPSVFIFPPSDEQLKSGTASVVCLLNNFYPREAKVQWKVDNALQSGNS QESVTEQDSKDSTYSLSSTLTLSKADYEKHKVYACEVTHQGLSSPVTKSFNR GEC |

In some embodiments, the antibody comprises a heavy chain having the amino acid sequence of SEQ ID NO: 140. In some embodiments, the antibody comprises a heavy chain having at least 90% sequence identity to the amino acid sequence of SEQ ID NO: 140. See Table 6.

In some embodiments, the antibody comprises a light chain having the amino acid sequence of SEQ ID NO: 141. In some embodiments, the antibody comprises a light chain having at least 90% sequence identity to the amino acid sequence of SEQ ID NO: 141. See Table 6.

In some embodiments, the antibody comprises a heavy chain having the amino acid sequence of SEQ ID NO: 140, and a light chain having the amino acid sequence of SEQ ID NO: 141. In some embodiments, the antibody comprises a heavy chain having at least 90% sequence identity to the amino acid sequence of SEQ ID NO: 140, and a light chain having at least 90% sequence identity to the amino acid sequence of SEQ ID NO: 141. See Table 6.

In some embodiments, the antibody comprises a heavy chain having the amino acid sequence of SEQ ID NO: 142. In some embodiments, the antibody comprises a heavy chain having at least 90% sequence identity to the amino acid sequence of SEQ ID NO: 142. See Table 6.

In some embodiments, the antibody comprises a light chain having the amino acid sequence of SEQ ID NO: 143. In some embodiments, the antibody comprises a light chain having at least 90% sequence identity to the amino acid sequence of SEQ ID NO: 143. See Table 6.

In some embodiments, the antibody comprises a heavy chain having the amino acid sequence of SEQ ID NO: 142, and a light chain having the amino acid sequence of SEQ ID NO: 143. In some embodiments, the antibody comprises a heavy chain having at least 90% sequence identity to the amino acid sequence of SEQ ID NO: 142, and a light chain having at least 90% sequence identity to the amino acid sequence of SEQ ID NO: 143. See Table 6.

In some embodiments, the antibody comprises a heavy chain having the amino acid sequence of SEQ ID NO: 144. In some embodiments, the antibody comprises a heavy chain having at least 90% sequence identity to the amino acid sequence of SEQ ID NO: 144. See Table 6.

In some embodiments, the antibody comprises a light chain having the amino acid sequence of SEQ ID NO: 145. In some embodiments, the antibody comprises a light chain having at least 90% sequence identity to the amino acid sequence of SEQ ID NO: 145. See Table 6.

In some embodiments, the antibody comprises a heavy having the amino acid sequence of SEQ ID NO: 144, and a light chain having the amino acid sequence of SEQ ID NO: 145. In some embodiments, the antibody comprises a heavy chain having at least 90% sequence identity to the amino acid sequence of SEQ ID NO: 144, and a light chain having at least 90% sequence identity to the amino acid sequence of SEQ ID NO: 145. See Table 6.

In some embodiments, the antibody comprises a heavy chain having the amino acid sequence of SEQ ID NO: 146. In some embodiments, the antibody comprises a heavy chain having at least 90% sequence identity to the amino acid sequence of SEQ ID NO: 146. See Table 6.

In some embodiments, the antibody comprises a light chain having the amino acid sequence of SEQ ID NO: 147. In some embodiments, the antibody comprises a light chain having at least 90% sequence identity to the amino acid sequence of SEQ ID NO: 147. See Table 6.

In some embodiments, the antibody comprises a heavy chain having the amino acid sequence of SEQ ID NO: 146, and a light chain having the amino acid sequence of SEQ ID NO: 147. In some embodiments, the antibody comprises a heavy chain having at least 90% sequence identity to the amino acid sequence of SEQ ID NO: 146, and a light chain having at least 90% sequence identity to the amino acid sequence of SEQ ID NO: 147. See Table 6.

In some embodiments, the antibody comprises a heavy chain having the amino acid sequence of SEQ ID NO: 148. In some embodiments, the antibody comprises a heavy chain having at least 90% sequence identity to the amino acid sequence of SEQ ID NO: 148. See Table 6.

In some embodiments, the antibody comprises a light chain having the amino acid sequence of SEQ ID NO: 149. In some embodiments, the antibody comprises a light chain having at least 90% sequence identity to the amino acid sequence of SEQ ID NO: 149. See Table 6.

In some embodiments, the antibody comprises a heavy chain having the amino acid sequence of SEQ ID NO: 148, and a light chain having the amino acid sequence of SEQ ID NO: 149. In some embodiments, the antibody comprises a heavy chain having at least 90% sequence identity to the amino acid sequence of SEQ ID NO: 148, and a light chain having at least 90% sequence identity to the amino acid sequence of SEQ ID NO: 149. See Table 6.

In some embodiments, the antibody comprises a heavy chain having the amino acid sequence of SEQ ID NO: 150. In some embodiments, the antibody comprises a heavy chain having at least 90% sequence identity to the amino acid sequence of SEQ ID NO: 150. See Table 6.

In some embodiments, the antibody comprises a light chain having the amino acid sequence of SEQ ID NO: 151. In some embodiments, the antibody comprises a light chain having at least 90% sequence identity to the amino acid sequence of SEQ ID NO: 151. See Table 6.

In some embodiments, the antibody comprises a heavy chain having the amino acid sequence of SEQ ID NO: 150, and a light chain having the amino acid sequence of SEQ ID NO: 151. In some embodiments, the antibody comprises a heavy chain having at least 90% sequence identity to the amino acid sequence of SEQ ID NO: 150, and a light chain having at least 90% sequence identity to the amino acid sequence of SEQ ID NO: 151. See Table 6.

In some embodiments, the antibody comprises a heavy chain having the amino acid sequence of SEQ ID NO: 152. In some embodiments, the antibody comprises a heavy chain having at least 90% sequence identity to the amino acid sequence of SEQ ID NO: 152. See Table 6.

In some embodiments, the antibody comprises a light chain having the amino acid sequence of SEQ ID NO: 153. In some embodiments, the antibody comprises a light chain having at least 90% sequence identity to the amino acid sequence of SEQ ID NO: 153. See Table 6.

In some embodiments, the antibody comprises a heavy chain having the amino acid sequence of SEQ ID NO: 152, and a light chain having the amino acid sequence of SEQ ID NO: 153. In some embodiments, the antibody comprises a heavy chain having at least 90% sequence identity to the amino acid sequence of SEQ ID NO: 152, and a light chain having at least 90% sequence identity to the amino acid sequence of SEQ ID NO: 153. See Table 6.

In some embodiments, the antibody comprises a heavy chain having the amino acid sequence of SEQ ID NO: 154. In some embodiments, the antibody comprises a heavy chain having at least 90% sequence identity to the amino acid sequence of SEQ ID NO: 154. See Table 6.

In some embodiments, the antibody comprises a light chain having the amino acid sequence of SEQ ID NO: 155. In some embodiments, the antibody comprises a light chain having at least 90% sequence identity to the amino acid sequence of SEQ ID NO: 155. See Table 6.

In some embodiments, the antibody comprises a heavy chain having the amino acid sequence of SEQ ID NO: 154, and a light chain having the amino acid sequence of SEQ ID NO: 155. In some embodiments, the antibody comprises a heavy chain having at least 90% sequence identity to the amino acid sequence of SEQ ID NO: 154, and a light chain having at least 90% sequence identity to the amino acid sequence of SEQ ID NO: 155. See Table 6.

In some embodiments, the antibody comprises a heavy chain having the amino acid sequence of SEQ ID NO: 156. In some embodiments, the antibody comprises a heavy chain having at least 90% sequence identity to the amino acid sequence of SEQ ID NO: 156. See Table 6.

In some embodiments, the antibody comprises a light chain having the amino acid sequence of SEQ ID NO: 157. In some embodiments, the antibody comprises a light chain having at least 90% sequence identity to the amino acid sequence of SEQ ID NO: 157. See Table 6.

In some embodiments, the antibody comprises a heavy chain having the amino acid sequence of SEQ ID NO: 156, and a light chain having the amino acid sequence of SEQ ID NO: 157. In some embodiments, the antibody comprises a heavy chain having at least 90% sequence identity to the amino acid sequence of SEQ ID NO: 156, and a light chain having at least 90% sequence identity to the amino acid sequence of SEQ ID NO: 157. See Table 6.

In some embodiments, the antibody comprises a heavy chain having the amino acid sequence of SEQ ID NO: 158. In some embodiments, the antibody comprises a heavy chain having at least 90% sequence identity to the amino acid sequence of SEQ ID NO: 158. See Table 6.

In some embodiments, the antibody comprises a light chain having the amino acid sequence of SEQ ID NO: 159. In some embodiments, the antibody comprises a light chain having at least 90% sequence identity to the amino acid sequence of SEQ ID NO: 159. See Table 6.

In some embodiments, the antibody comprises a heavy chain having the amino acid sequence of SEQ ID NO: 158, and a light chain having the amino acid sequence of SEQ ID NO: 159. In some embodiments, the antibody comprises a heavy chain having at least 90% sequence identity to the amino acid sequence of SEQ ID NO: 158, and a light chain having at least 90% sequence identity to the amino acid sequence of SEQ ID NO: 159. See Table 6.

In some embodiments, the antibody comprises a heavy chain having the amino acid sequence of SEQ ID NO: 160. In some embodiments, the antibody comprises a heavy chain having at least 90% sequence identity to the amino acid sequence of SEQ ID NO: 160. See Table 6.

In some embodiments, the antibody comprises a light chain having the amino acid sequence of SEQ ID NO: 161. In some embodiments, the antibody comprises a light chain having at least 90% sequence identity to the amino acid sequence of SEQ ID NO: 161. See Table 6.

In some embodiments, the antibody comprises a heavy chain having the amino acid sequence of SEQ ID NO: 160, and a light chain having the amino acid sequence of SEQ ID NO: 161. In some embodiments, the antibody comprises a heavy chain having at least 90% sequence identity to the amino acid sequence of SEQ ID NO: 160, and a light chain having at least 90% sequence identity to the amino acid sequence of SEQ ID NO: 161. See Table 6.

In some embodiments, the antibody comprises a heavy chain having the amino acid sequence of SEQ ID NO: 162. In some embodiments, the antibody comprises a heavy chain having at least 90% sequence identity to the amino acid sequence of SEQ ID NO: 162. See Table 6.

In some embodiments, the antibody comprises a light chain having the amino acid sequence of SEQ ID NO: 163. In some embodiments, the antibody comprises a light chain having at least 90% sequence identity to the amino acid sequence of SEQ ID NO: 163. See Table 6.

In some embodiments, the antibody comprises a heavy chain having the amino acid sequence of SEQ ID NO: 162, and a light chain having the amino acid sequence of SEQ ID NO: 163. In some embodiments, the antibody comprises a heavy chain having at least 90% sequence identity to the amino acid sequence of SEQ ID NO: 162, and a light chain having at least 90% sequence identity to the amino acid sequence of SEQ ID NO: 163. See Table 6.

In some embodiments, the antibody comprises a heavy chain having the amino acid sequence of SEQ ID NO: 164. In some embodiments, the antibody comprises a heavy chain having at least 90% sequence identity to the amino acid sequence of SEQ ID NO: 164. See Table 6.

In some embodiments, the antibody comprises a light chain having the amino acid sequence of SEQ ID NO: 165. In some embodiments, the antibody comprises a light chain having at least 90% sequence identity to the amino acid sequence of SEQ ID NO: 165. See Table 6.

In some embodiments, the antibody comprises a heavy chain having the amino acid sequence of SEQ ID NO: 164, and a light chain having the amino acid sequence of SEQ ID NO: 165. In some embodiments, the antibody comprises a heavy chain having at least 90% sequence identity to the amino acid sequence of SEQ ID NO: 164, and a light chain having at least 90% sequence identity to the amino acid sequence of SEQ ID NO: 165. See Table 6.

In some embodiments, the antibody comprises a heavy chain having the amino acid sequence of SEQ ID NO: 166. In some embodiments, the antibody comprises a heavy chain having at least 90% sequence identity to the amino acid sequence of SEQ ID NO: 166. See Table 6.

In some embodiments, the antibody comprises a light chain having the amino acid sequence of SEQ ID NO: 167. In some embodiments, the antibody comprises a light chain having at least 90% sequence identity to the amino acid sequence of SEQ ID NO: 167. See Table 6.

In some embodiments, the antibody comprises a heavy chain having the amino acid sequence of SEQ ID NO: 166, and a light chain having the amino acid sequence of SEQ ID NO: 167. In some embodiments, the antibody comprises a heavy chain having at least 90% sequence identity to the amino acid sequence of SEQ ID NO: 166, and a light chain having at least 90% sequence identity to the amino acid sequence of SEQ ID NO: 167. See Table 6.

In some embodiments, the antibody comprises a heavy chain having the amino acid sequence of SEQ ID NO: 168. In some embodiments, the antibody comprises a heavy chain having at least 90% sequence identity to the amino acid sequence of SEQ ID NO: 168. See Table 6.

In some embodiments, the antibody comprises a light chain having the amino acid sequence of SEQ ID NO: 169. In some embodiments, the antibody comprises a light chain having at least 90% sequence identity to the amino acid sequence of SEQ ID NO: 169. See Table 6.

In some embodiments, the antibody comprises a heavy chain having the amino acid sequence of SEQ ID NO: 168, and a light chain having the amino acid sequence of SEQ ID NO: 169. In some embodiments, the antibody comprises a heavy chain having at least 90% sequence identity to the amino acid sequence of SEQ ID NO: 168, and a light chain having at least 90% sequence identity to the amino acid sequence of SEQ ID NO: 169. See Table 6.

In some embodiments, the antibody comprises a heavy chain having the amino acid sequence of SEQ ID NO: 170. In some embodiments, the antibody comprises a heavy chain having at least 90% sequence identity to the amino acid sequence of SEQ ID NO: 170. See Table 6.

In some embodiments, the antibody comprises a light chain having the amino acid sequence of SEQ ID NO: 171. In some embodiments, the antibody comprises a light chain having at least 90% sequence identity to the amino acid sequence of SEQ ID NO: 171. See Table 6.

In some embodiments, the antibody comprises a heavy chain having the amino acid sequence of SEQ ID NO: 170, and a light chain having the amino acid sequence of SEQ ID NO: 171. In some embodiments, the antibody comprises a heavy chain having at least 90% sequence identity to the amino acid sequence of SEQ ID NO: 170, and a light chain having at least 90% sequence identity to the amino acid sequence of SEQ ID NO: 171. See Table 6.

In some embodiments, the antibody comprises a heavy chain having the amino acid sequence of SEQ ID NO: 172. In some embodiments, the antibody comprises a heavy chain having at least 90% sequence identity to the amino acid sequence of SEQ ID NO: 172. See Table 6.

In some embodiments, the antibody comprises a light chain having the amino acid sequence of SEQ ID NO: 173. In some embodiments, the antibody comprises a light chain having at least 90% sequence identity to the amino acid sequence of SEQ ID NO: 173. See Table 6.

In some embodiments, the antibody comprises a heavy chain having the amino acid sequence of SEQ ID NO: 172, and a light chain having the amino acid sequence of SEQ ID NO: 173. In some embodiments, the antibody comprises a heavy chain having at least 90% sequence identity to the amino acid sequence of SEQ ID NO: 172, and a light chain having at least 90% sequence identity to the amino acid sequence of SEQ ID NO: 173. See Table 6.

In some embodiments, the antibody comprises a heavy chain having the amino acid sequence of SEQ ID NO: 174. In some embodiments, the antibody comprises a heavy chain having at least 90% sequence identity to the amino acid sequence of SEQ ID NO: 174. See Table 6.

In some embodiments, the antibody comprises a light chain having the amino acid sequence of SEQ ID NO: 175. In some embodiments, the antibody comprises a light chain having at least 90% sequence identity to the amino acid sequence of SEQ ID NO: 175. See Table 6.

In some embodiments, the antibody comprises a heavy chain having the amino acid sequence of SEQ ID NO: 174, and a light chain having the amino acid sequence of SEQ ID NO: 175. In some embodiments, the antibody comprises a heavy chain having at least 90% sequence identity to the amino acid sequence of SEQ ID NO: 174, and a light chain having at least 90% sequence identity to the amino acid sequence of SEQ ID NO: 175. See Table 6.

TABLE 6

Heavy chain and light chain amino acid sequences of additional anti-Factor D antibodies

| | | |
|---|---|---|
| SEQ ID NO: 140 | huAFD.v2.0 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YWGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKSCDKTHT |
| SEQ ID NO: 141 | huAFD.v2.0 Light Chain | DIQMTQSPSSLSASVGDRVTITCKASQNVDTDVAWFQQKPGKAPKGLIYSAS SRYSGVPSRFSGSGSGTDFTLTISSLQPEDFATYYCQQYNNYPLTFGQGTKVE IKRTVAAPSVFIFPPSDEQLKSGTASVVCLLNNFYPREAKVQWKVDNALQSG NSQESVTEQDSKDSTYSLSSTLTLSKADYEKHKVYACEVTHQGLSSPVTKSF NRGEC |
| SEQ ID NO: 142 | huAFD.v2.1 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YWGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKSCDKTHT |
| SEQ ID NO: 143 | huAFD.v2.1 Light Chain | DIQMTQSPSSLSASVGDRVTITCKASQNVDTDVAWFQQKPGKAPKGLIRSAS SRYSGVPSRFSGSGSGTDFTLTISSLQPEDFATYYCQQYNNYPLTFGQGTKVE IKRTVAAPSVFIFPPSDEQLKSGTASVVCLLNNFYPREAKVQWKVDNALQSG NSQESVTEQDSKDSTYSLSSTLTLSKADYEKHKVYACEVTHQGLSSPVTKSF NRGEC |

TABLE 6-continued

Heavy chain and light chain amino acid sequences of additional anti-Factor D antibodies

| | | |
|---|---|---|
| SEQ ID NO: 144 | huAFD.v2.3 Heavy Chain | EVQLVQSGAEVKKPGASVKVSCKASGYTFTSYYMYWVRQAPGQGLEWIGE INPYSGDTNFNEKFKSRATLTVDTSTSTAYLELSSLRSEDTAVYYCAREGGF AYWGQGTLVTVSSASTKGPSVFPLAPSSKSTSGGTAALGCLVKDYFPEPVTV SWNSGALTSGVHTFPAVLQSSGLYSLSSVVTVPSSSLGTQTYICNVNHKPSN TKVDKKVEPKSCDKTHT |
| SEQ ID NO: 145 | huAFD.v2.3 Light Chain | DIQMTQSPSSLSASVGDRVTITCKASQNVDTDVAWFQQKPGKAPKGLIRSAS SRYSGVPSRFSGSGSGTDFTLTISSLQPEDFATYYCQQYNNYPLTFGQGTKVE IKRTVAAPSVFIFPPSDEQLKSGTASVVCLLNNFYPREAKVQWKVDNALQSG NSQESVTEQDSKDSTYSLSSTLTLSKADYEKHKVYACEVTHQGLSSPVTKSF NRGEC |
| SEQ ID NO: 146 | huAFD.v1 Heavy Chain | EVQLVQSGAEVKKPGASVKVSCKASGYTFTSYYMYWVRQAPGQGLEWIGE INPTNGGTNFNEKFKSRATLTVDTSTSTAYLELSSLRSEDTAVYYCAREGGF AYWGQGTLVTVSSASTKGPSVFPLAPSSKSTSGGTAALGCLVKDYFPEPVTV SWNSGALTSGVHTFPAVLQSSGLYSLSSVVTVPSSSLGTQTYICNVNHKPSN TKVDKKVEPKSCDKTHT |
| SEQ ID NO: 147 | huAFD.v1 Light Chain | DIQMTQSPSSLSASVGDRVTITCKASQNVDTDVAWFQQKPGKAPKGLIYSAS SRYSGVPSRFSGSGSGTDFTLTISSLQPEDFATYYCQQYNNYPLTFGQGTKVE IKRTVAAPSVFIFPPSDEQLKSGTASVVCLLNNFYPREAKVQWKVDNALQSG NSQESVTEQDSKDSTYSLSSTLTLSKADYEKHKVYACEVTHQGLSSPVTKSF NRGEC |
| SEQ ID NO: 148 | huAFD.v1.1 Heavy Chain | EVQLVQSGAEVKKPGASVKVSCKASGYTFTSYYMYWVRQAPGQGLEWIGE INPTQGGTNFNEKFKSRATLTVDTSTSTAYLELSSLRSEDTAVYYCAREGGF AYWGQGTLVTVSSASTKGPSVFPLAPSSKSTSGGTAALGCLVKDYFPEPVTV SWNSGALTSGVHTFPAVLQSSGLYSLSSVVTVPSSSLGTQTYICNVNHKPSN TKVDKKVEPKSCDKTHT |
| SEQ ID NO: 149 | huAFD.v1.1 Light Chain | DIQMTQSPSSLSASVGDRVTITCKASQNVDTDVAWFQQKPGKAPKGLIYSAS SRYSGVPSRFSGSGSGTDFTLTISSLQPEDFATYYCQQYNNYPLTFGQGTKVE IKRTVAAPSVFIFPPSDEQLKSGTASVVCLLNNFYPREAKVQWKVDNALQSG NSQESVTEQDSKDSTYSLSSTLTLSKADYEKHKVYACEVTHQGLSSPVTKSF NRGEC |
| SEQ ID NO: 150 | huAFD.v2.2 Heavy Chain | EVQLVQSGAEVKKPGASVKVSCKASGYTFTSYYMYWVRQAPGQGLEWIGE INPTSGDTNFNEKFKSRATLTVDTSTSTAYLELSSLRSEDTAVYYCAREGGFA YWGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKSCDKTHT |
| SEQ ID NO: 151 | huAFD.v2.2 Light Chain | DIQMTQSPSSLSASVGDRVTITCKASQNVDTDVAWFQQKPGKAPKGLIYSAS SRYSGVPSRFSGSGSGTDFTLTISSLQPEDFATYYCQQYNNYPLTFGQGTKVE IKRTVAAPSVFIFPPSDEQLKSGTASVVCLLNNFYPREAKVQWKVDNALQSG NSQESVTEQDSKDSTYSLSSTLTLSKADYEKHKVYACEVTHQGLSSPVTKSF NRGEC |
| SEQ ID NO: 152 | huAFD.v2.4 Heavy Chain | EVQLVQSGAEVKKPGASVKVSCKASGYTFTSYYMYWVRQAPGQGLEWIGE INPTSGETNFNEKFKSRATLTVDTSTSTAYLELSSLRSEDTAVYYCAREGGFA YWGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKSCDKTHT |
| SEQ ID NO: 153 | huAFD.v2.4 Light Chain | DIQMTQSPSSLSASVGDRVTITCKASQNVDTDVAWFQQKPGKAPKGLIYSAS SRYSGVPSRFSGSGSGTDFTLTISSLQPEDFATYYCQQYNNYPLTFGQGTKVE IKRTVAAPSVFIFPPSDEQLKSGTASVVCLLNNFYPREAKVQWKVDNALQSG NSQESVTEQDSKDSTYSLSSTLTLSKADYEKHKVYACEVTHQGLSSPVTKSF NRGEC |
| SEQ ID NO: 154 | huAFD.v2.5 Heavy Chain | EVQLVQSGAEVKKPGASVKVSCKASGYTFTSYYMYWVRQAPGQGLEWIGE INPYSGGTNFNEKFKSRATLTVDTSTSTAYLELSSLRSEDTAVYYCAREGGF AYWGQGTLVTVSSASTKGPSVFPLAPSSKSTSGGTAALGCLVKDYFPEPVTV SWNSGALTSGVHTFPAVLQSSGLYSLSSVVTVPSSSLGTQTYICNVNHKPSN TKVDKKVEPKSCDKTHT |
| SEQ ID NO: 155 | huAFD.v2.5 Light Chain | DIQMTQSPSSLSASVGDRVTITCKASQNVDTDVAWFQQKPGKAPKGLIYSAS SRYSGVPSRFSGSGSGTDFTLTISSLQPEDFATYYCQQYNNYPLTFGQGTKVE IKRTVAAPSVFIFPPSDEQLKSGTASVVCLLNNFYPREAKVQWKVDNALQSG NSQESVTEQDSKDSTYSLSSTLTLSKADYEKHKVYACEVTHQGLSSPVTKSF NRGEC |
| SEQ ID NO: 156 | huAFD.v2.6 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YWGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKSCDKTHT |

TABLE 6-continued

Heavy chain and light chain amino acid sequences of additional anti-Factor D antibodies

| | | |
|---|---|---|
| SEQ ID NO: 157 | huAFD.v2.6 Light Chain | DIQMTQSPSSLSASVGDRVTITCKASQNVDTDVAWFQQKPGKAPKGLISSAS SRYSGVPSRFSGSGSGTDFTLTISSLQPEDFATYYCQQYNNYPLTFGQGTKVE IKRTVAAPSVFIFPPSDEQLKSGTASVVCLLNNFYPREAKVQWKVDNALQSG NSQESVTEQDSKDSTYSLSSTLTLSKADYEKHKVYACEVTHQGLSSPVTKSF NRGEC |
| SEQ ID NO: 158 | huAFD.v2.7 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YWGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKSCDKTHT |
| SEQ ID NO: 159 | huAFD.v2.7 Light Chain | DIQMTQSPSSLSASVGDRVTITCKASQNVDTDVAWFQQKPGKAPKGLIKSAS SRYSGVPSRFSGSGSGTDFTLTISSLQPEDFATYYCQQYNNYPLTFGQGTKVE IKRTVAAPSVFIFPPSDEQLKSGTASVVCLLNNFYPREAKVQWKVDNALQSG NSQESVTEQDSKDSTYSLSSTLTLSKADYEKHKVYACEVTHQGLSSPVTKSF NRGEC |
| SEQ ID NO: 160 | huAFD.v2.8 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YWGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKSCDKTHT |
| SEQ ID NO: 161 | huAFD.v2.8 Light Chain | DIQMTQSPSSLSASVGDRVTITCKASQNVDTDVAWFQQKPGKAPKGLIQSAS SRYSGVPSRFSGSGSGTDFTLTISSLQPEDFATYYCQQYNNYPLTFGQGTKVE NSQESVTEQDSKDSTYSLSSTLTLSKADYEKHKVYACEVTHQGLSSPVTKSF NRGEC |
| SEQ ID NO: 162 | huAFD.v2.9 Heavy Chain | EVQLVQSGAEVKKPGASVKVSCKASGYTFTSYYMYWVRQAPGQGLEWIG WINPTSGGTNFNEKFKSRATLTVDTSTSTAYLELSSLRSEDTAVYYCAREGG FAYWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKSCDKTHT |
| SEQ ID NO: 163 | huAFD.v2.9 Light Chain | DIQMTQSPSSLSASVGDRVTITCKASQNVDTDVAWFQQKPGKAPKGLIYSAS SRYSGVPSRFSGSGSGTDFTLTISSLQPEDFATYYCQQYNNYPLTFGQGTKVE IKRTVAAPSVFIFPPSDEQLKSGTASVVCLLNNFYPREAKVQWKVDNALQSG NSQESVTEQDSKDSTYSLSSTLTLSKADYEKHKVYACEVTHQGLSSPVTKSF NRGEC |
| SEQ ID NO: 164 | huAFD.v2.10 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YWGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKSCDKTHT |
| SEQ ID NO: 165 | huAFD.v2.10 Light Chain | DIQMTQSPSSLSASVGDRVTITCKASQNVDTDVAWFQQKPGKAPKGLIYSAS SRKSGVPSRFSGSGSGTDFTLTISSLQPEDFATYYCQQYNNYPLTFGQGTKVE IKRTVAAPSVFIFPPSDEQLKSGTASVVCLLNNFYPREAKVQWKVDNALQSG NSQESVTEQDSKDSTYSLSSTLTLSKADYEKHKVYACEVTHQGLSSPVTKSF NRGEC |
| SEQ ID NO: 166 | huAFD.v2.11 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YWGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKSCDKTHT |
| SEQ ID NO: 167 | huAFD.v2.11 Light Chain | DIQMTQSPSSLSASVGDRVTITCKASQNVDTDVAWFQQKPGKAPKGLIYSAS SRRSGVPSRFSGSGSGTDFTLTISSLQPEDFATYYCQQYNNYPLTFGQGTKVE IKRTVAAPSVFIFPPSDEQLKSGTASVVCLLNNFYPREAKVQWKVDNALQSG NSQESVTEQDSKDSTYSLSSTLTLSKADYEKHKVYACEVTHQGLSSPVTKSF NRGEC |
| SEQ ID NO: 168 | huAFD.v2.12 Heavy Chain | EVQLVQSGAEVKKPGASVKVSCKASGYTFTSYYMYWVRQAPGQGLEWIGE INPYSGGTNFNEKFKSRATLTVDTSTSTAYLELSSLRSEDTAVYYCAREGGF AYWGQGTLVTVSSASTKGPSVFPLAPSSKSTSGGTAALGCLVKDYFPEPVTV SWNSGALTSGVHTFPAVLQSSGLYSLSSVVTVPSSSLGTQTYICNVNHKPSN TKVDKKVEPKSCDKTHT |
| SEQ ID NO: 169 | huAFD.v2.12 Light Chain | DIQMTQSPSSLSASVGDRVTITCKASQNVDTDVAWFQQKPGKAPKGLIRSAS SRYSGVPSRFSGSGSGTDFTLTISSLQPEDFATYYCQQYNNYPLTFGQGTKVE IKRTVAAPSVFIFPPSDEQLKSGTASVVCLLNNFYPREAKVQWKVDNALQSG NSQESVTEQDSKDSTYSLSSTLTLSKADYEKHKVYACEVTHQGLSSPVTKSF NRGEC |

TABLE 6-continued

Heavy chain and light chain amino acid sequences of additional anti-Factor D antibodies

| SEQ ID NO: 170 | huAFD.v2.13 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YWGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKSCDKTHT |
|---|---|---|
| SEQ ID NO: 171 | huAFD.v2.13 Light Chain | DIQMTQSPSSLSASVGDRVTITCKASQNVDTDVAWFQQKPGKAPKGLIRSAS SRYSGVPSRFSGSGSGTDFTLTISSLQPEDFATYYCQQYENYPLTFGQGTKVE IKRTVAAPSVFIFPPSDEQLKSGTASVVCLLNNFYPREAKVQWKVDNALQSG NSQESVTEQDSKDSTYSLSSTLTLSKADYEKHKVYACEVTHQGLSSPVTKSF NRGEC |
| SEQ ID NO: 172 | huAFD.v2.14 Heavy Chain | EVQLVQSGAEVKKPGASVKVSCKASGYTFTSYYMYWVRQAPGQGLEWIGE INPTSGETNFNEKFKSRATLTVDTSTSTAYLELSSLRSEDTAVYYCAREGGFA YWGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKSCDKTHT |
| SEQ ID NO: 173 | huAFD.v2.14 Light Chain | DIQMTQSPSSLSASVGDRVTITCKASQNVDTDVAWFQQKPGKAPKGLIRSAS SRYSGVPSRFSGSGSGTDFTLTISSLQPEDFATYYCQQYNNYPLTFGQGTKVE IKRTVAAPSVFIFPPSDEQLKSGTASVVCLLNNFYPREAKVQWKVDNALQSG NSQESVTEQDSKDSTYSLSSTLTLSKADYEKHKVYACEVTHQGLSSPVTKSF NRGEC |
| SEQ ID NO: 174 | huAFD.v2.15 Heavy Chain | EVQLVQSGAEVKKPGASVKVSCKASGYTFTSYYMYWVRQAPGQGLEWIGE INPYSGETNFNEKFKSRATLTVDTSTSTAYLELSSLRSEDTAVYYCAREGGFA YWGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKSCDKTHT |
| SEQ ID NO: 175 | huAFD.v2.15 Light Chain | DIQMTQSPSSLSASVGDRVTITCKASQNVDTDVAWFQQKPGKAPKGLIRSAS SRYSGVPSRFSGSGSGTDFTLTISSLQPEDFATYYCQQYNNYPLTFGQGTKVE IKRTVAAPSVFIFPPSDEQLKSGTASVVCLLNNFYPREAKVQWKVDNALQSG NSQESVTEQDSKDSTYSLSSTLTLSKADYEKHKVYACEVTHQGLSSPVTKSF NRGEC |

The antibody and antigen-binding fragments described herein can also be further covalently modified by conjugating the antibody or antigen-binding fragments to one of a variety of non-proteinacious polymer molecules. The antibody-polymer conjugates can be made using any suitable technique for derivatizing antibody with polymers, and are not limited to conjugates utilizing any particular type of linkage between an antibody or antibody fragment and a polymer.

In one aspect, the conjugates include species wherein a polymer is covalently attached to a specific site or specific sites on the parental antibody, i.e. polymer attachment is targeted to a particular region or a particular amino acid residue or residues in the parental antibody or antibody fragment. Site specific conjugation of polymers is most commonly achieved by attachment to cysteine residues in the parental antibody or antibody fragment. In such embodiments, the coupling chemistry can, for example, utilize the free sulfhydryl group of a cysteine residue not in a disulfide bridge in the parental antibody. The polymer can be activated with any functional group that is capable of reacting specifically with the free sulfhydryl or thiol group(s) on the parental antibody, such as maleimide, sulfhydryl, thiol, triflate, tesylate, aziridine, exirane, and 5-pyridyl functional groups. The polymer can be coupled to the parental antibody using any protocol suitable for the chemistry of the coupling system selected, such as the protocols and systems described in U.S. Pat. Nos. 4,179,337; 7,122,636, and Jevsevar et al. (2010) Biotech. J. 5:113-128.

In some embodiments, one or more cysteine residue(s) naturally present in the parental antibody is (are) used as attachment site(s) for polymer conjugation. In some embodiments, one or more cysteine residue(s) is (are) engineered into a selected site or sites in the parental antibody for the purpose of providing a specific attachment site or sites for polymer. Cysteine engineered antibodies have been described previously (U.S. Pat. Pub. No. 2007/0092940 and Junutula, J. R., et al, J. Immunol Methods, Vol. 332(1-2), pp. 41-52 (2008), all herein incorporated by reference in their entirety). In some embodiments, cysteine engineered antibodies can be parental antibodies. These are useful for generating antibody fragments having a free cysteine in a particular location, typically in a constant region, e.g., CL or CH1. A parent antibody engineered to contain a cysteine may be referred to as a "ThioMab" and Fab fragments produced from such cysteine engineered antibodies, regardless of the method of production, may be referred as "ThioMabs" or "ThioFabs." As described previously (see, e.g., U.S. Pat. Pub. No. 2007/0092940 and Junutula, J. R., et al, J. Immunol Methods, Vol. 332(1-2), pp. 41-52 (2008)), mutants with replaced ("engineered") cysteine (Cys) residues are evaluated for the reactivity of the newly introduced, engineered cysteine thiol groups. The thiol reactivity value is a relative, numerical term in the range of 0 to 1.0 and can be measured for any cysteine engineered antibody. In addition to having a reactive thiol group, ThioMabs should be selected such that they retain antigen binding capability. The design, selection, and preparation of cysteine engineered antibodies were described in detail previously (see, e.g., WO 2011/069104, which is herein incorporated by reference). Engineered cysteines are preferably introduced into the constant domains of heavy or light chains. As such, the cysteine engineered antibodies will preferably retain the antigen binding capability of their wild type, parent antibody counterparts and, as such, are capable of binding specifically, to antigens.

In one aspect, the invention encompasses antibody-polymer conjugates, wherein the antibody is a Fab fragment, and the polymer is attached to one or more cysteine residue in the light or heavy chain of the Fab fragment that would ordinarily form the inter-chain disulfide bond linking the light and heavy chains. In some embodiments, one or more cysteine residue(s) naturally present in the hinge region of the antibody is (are) used to attach the polymer. In some embodiments, one or more cysteine residues is (are) engineered into the hinge region of the Fab fragment for the purpose of providing a specific attachment site or sites for polymer.

In another aspect, the invention encompasses antibody-polymer conjugates, wherein the antibody is a Fab-C or Fab' fragment, and the polymer attachment is targeted to the hinge region of the Fab-C or Fab' fragment. In some embodiments, one or more cysteine residue(s) naturally present in the hinge region of the antibody is (are) used to attach the polymer. In some embodiments, one or more cysteine residues is (are) added to the C-terminus of the Fab fragment for the purpose of providing a specific attachment site or sites for polymer.

In another aspect, the invention encompasses antibody-polymer conjugates, wherein the antibody is a F(ab')2 fragment, and the polymer attachment is targeted to the hinge region of the F(ab')2 fragment. In some embodiments, one or more cysteine residue(s) naturally present in the hinge region of the antibody is (are) used to attach the polymer. In some embodiments, one or more cysteine residues is (are) engineered into the hinge region of the F(ab')2 fragment for the purpose of providing a specific attachment site or sites for polymer.

In some embodiments, the anti-Factor D antibody (e.g., Fab fragment, Fab' fragment, or F(ab')2 fragment) is modified by adding one cysteine at the C'-terminal end of the heavy chain for the purpose of providing one attachment site for polymer conjugation. In some embodiments, the anti-Factor D antibody (e.g., Fab fragment, Fab' fragment, or F(ab')2 fragment) is modified by adding four additional residues, Cys-Pro-Pro-Cys, at the C'-terminal end of the heavy chain for the purpose of providing two attachment sites for polymer conjugation. In some embodiments, the anti-Factor D antibody (e.g., Fab fragment, Fab' fragment, or F(ab')2 fragment) is modified by adding four additional residues, Cys-Pro-Pro-Ser, at the C'-terminal end of the heavy chain for the purpose of providing one attachment site for polymer conjugation. In some embodiments, the anti-Factor D antibody (e.g., Fab fragment, Fab' fragment, or F(ab')2 fragment) is modified by adding four additional residues, Ser-Pro-Pro-Cys, at the C'-terminal end of the heavy chain for the purpose of providing one attachment site for polymer conjugation. In some embodiments, the anti-Factor D antibody (e.g., Fab fragment, Fab' fragment, or F(ab')2 fragment) is modified by adding four additional residues, Ala-Pro-Pro-Cys, at the C'-terminal end of the heavy chain for the purpose of providing one attachment site for polymer conjugation. In some embodiments, the anti-Factor D antibody (e.g., Fab fragment, Fab' fragment, or F(ab')2 fragment) is modified by adding four additional residues, Ser-Gly-Gly-Cys, at the C'-terminal end of the heavy chain for the purpose of providing one attachment site for polymer conjugation. In specific embodiments, the polymer conjugation is PEG polymer conjugation.

One commonly used antibody conjugation is PEGylation, wherein one or more polyethylene glycol (PEG) polymers are covalently attached to the antibody's constant region. See U.S. Pat. Nos. 4,179,337; 7,122,636. PEG polymers of different sizes (e.g., from about 500 D to about 300,000 D) and shapes (e.g., linear or branched) have been known and widely used in the field. The polymers useful for the present invention may be obtained commercially (e.g., from Nippon Oil and Fats; Nektar Therapeutics; Creative PEGWorks) or prepared from commercially available starting materials using conventional chemical procedures. PEGylation changes the physical and chemical properties of the antibody drug, and may results in improved pharmacokinetic behaviors such as improved stability, decreased immunogenicity, extended circulating life as well as increased residence time.

In some embodiments, the antibody (e.g., a Fab fragment, a Fab' fragment, a Fab-C fragment or a F(ab')2 fragment) comprises a heavy chain having the amino acid sequence of SEQ ID NO: 176. In some embodiments, the antibody (e.g., a Fab fragment, a Fab' fragment, a Fab-C fragment or a F(ab')2 fragment) comprises a heavy chain having at least 90% sequence identity to the amino acid sequence of SEQ ID NO: 176. In some embodiments, the antibody (e.g., a Fab' fragment, a Fab-C fragment or a F(ab')2 fragment) comprises a heavy chain having the amino acid sequence of SEQ ID NO: 176, wherein the cysteine at the C' Terminal end is attached to a polymer (e.g., a PEG polymer). In some embodiments, the antibody (e.g., a Fab' fragment, a Fab-C fragment or a F(ab')2 fragment) comprises a heavy chain having at least 90% sequence identity to the amino acid sequence of SEQ ID NO: 176, wherein the cysteine at the C' Terminal end is attached to a polymer (e.g., a PEG polymer). See Table 7.

In some embodiments, the antibody (e.g., a Fab fragment, a Fab' fragment, a Fab-C fragment or a F(ab')2 fragment) comprises a heavy chain having the amino acid sequence of SEQ ID NO: 177. In some embodiments, the antibody (e.g., a Fab fragment, a Fab' fragment, a Fab-C fragment or a F(ab')2 fragment) comprises a heavy chain having at least 90% sequence identity to the amino acid sequence of SEQ ID NO: 177. In some embodiments, the antibody (e.g., a Fab' fragment, a Fab-C fragment or a F(ab')2 fragment) comprises a heavy chain having the amino acid sequence of SEQ ID NO: 177, wherein the two cysteines in the Cys-Pro-Pro-Cys sequence at the C' Terminal end are each attached to a polymer (e.g., a PEG polymer). In some embodiments, the antibody (e.g., a Fab' fragment, a Fab-C fragment or a F(ab')2 fragment) comprises a heavy chain having at least 90% sequence identity to the amino acid sequence of SEQ ID NO: 177, wherein the two cysteines in the Cys-Pro-Pro-Cys sequence at the C' Terminal end are each attached to a polymer (e.g., a PEG polymer). See Table 7.

In some embodiments, the antibody (e.g., a Fab fragment, a Fab' fragment, a Fab-C fragment or a F(ab')2 fragment) comprises a heavy chain having the amino acid sequence of SEQ ID NO: 178. In some embodiments, the antibody (e.g., a Fab fragment, a Fab' fragment, a Fab-C fragment or a F(ab')2 fragment) comprises a heavy chain having at least 90% sequence identity to the amino acid sequence of SEQ ID NO: 178. In some embodiments, the antibody (e.g., a Fab' fragment, a Fab-C fragment or a F(ab')2 fragment) comprises a heavy chain having the amino acid sequence of SEQ ID NO: 178, wherein the cysteine at the C' Terminal end is attached to a polymer (e.g., a PEG polymer). In some embodiments, the antibody (e.g., a Fab' fragment, a Fab-C fragment or a F(ab')2 fragment) comprises a heavy chain having at least 90% sequence identity to the amino acid sequence of SEQ ID NO: 178, wherein the cysteine at the C' Terminal end is attached to a polymer (e.g., a PEG polymer). See Table 7.

In some embodiments, the antibody (e.g., a Fab fragment, a Fab' fragment, a Fab-C fragment or a F(ab')2 fragment) comprises a heavy chain having the amino acid sequence of SEQ ID NO: 179. In some embodiments, the antibody (e.g., a Fab fragment, a Fab' fragment, a Fab-C fragment or a F(ab')2 fragment) comprises a heavy chain having at least 90% sequence identity to the amino acid sequence of SEQ ID NO: 179. In some embodiments, the antibody (e.g., a Fab' fragment, a Fab-C fragment or a F(ab')2 fragment) comprises a heavy chain having the amino acid sequence of SEQ ID NO: 179, wherein the two cysteines in the Cys-Pro-Pro-Cys sequence at the C' Terminal end are each attached to a polymer (e.g., a PEG polymer). In some embodiments, the antibody (e.g., a Fab' fragment, a Fab-C fragment or a F(ab')2 fragment) comprises a heavy chain having at least 90% sequence identity to the amino acid sequence of SEQ ID NO: 179, wherein the two cysteines in the Cys-Pro-Pro-Cys sequence at the C' Terminal end are each attached to a polymer (e.g., a PEG polymer). See Table 7.

F(ab')2 fragment of an IgG2 isotype. In specific embodiments, the anti-Factor D antibody is a Fab fragment, a Fab' fragment, a Fab-C fragment or a F(ab')2 fragment of an IgG4 isotype. In specific embodiments, the anti-Factor D antibody is a Fab fragment, a Fab' fragment, a Fab-C fragment or a F(ab')2 fragment of an IgG1 isotype.

In specific embodiments, the anti-Factor D antibody is a Fab fragment whose C-terminal of the heavy chain is modified to terminate with Cys-Asp (CD), Cys-Asp-Lys (CDK), Cys-Asp-Lys-Thr (CDKT), Cys-Asp-Lys-Thr-His (CDKTH), Cys-Asp-Lys-Thr-His-Thr (CDKTHT), or Cys-Asp-Lys-Thr-His-Leu (CDKTHL). In specific embodiments, the anti-Factor D antibody is a Fab fragment whose C-terminal of the heavy chain is modified to terminate with Cys-Asp (CD), Cys-Asp-Lys (CDK), Cys-Asp-Lys-Thr (CDKT), Cys-Asp-Lys-Thr-His (CDKTH), or Cys-Asp-Lys-Thr-His-Leu (CDKTHL). In specific embodiments, the anti-Factor D antibody is a Fab fragment whose C-terminal of the heavy chain is modified to terminate with Cys-Asp (CD) or Cys-Asp-Lys-Thr-His-Leu (CDKTHL). In specific embodiments, the anti-Factor D antibody is a Fab fragment whose C-terminal of the heavy chain is modified to terminate with

TABLE 7

Heavy chain and light chain amino acid sequences of cysteine-modified anti-Factor D antibodies

| | | |
|---|---|---|
| SEQ ID NO: 176 | Cys-Modified AFD.v8 Heavy Chain | EVQLVQSGPELKKPGASVKVSCKASGYTFTNYGMNWVRQAPGQGLEWMG WINTYTGETTYAEDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKSCDKTHTC |
| SEQ ID NO: 177 | Cys-Pro-Pro-Cys-Modified AFD.v8 Heavy Chain | EVQLVQSGPELKKPGASVKVSCKASGYTFTNYGMNWVRQAPGQGLEWMG WINTYTGETTYAEDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKSCDKTHTCPPC |
| SEQ ID NO: 178 | Cys-Modified AFD.v14 Heavy Chain | EVQLVQSGPELKKPGASVKVSCKASGYTFTNYGMNWVRQAPGQGLEWMG WINTYTGETTYAEDFKGRFVFSLDTSVSTAYLQISSLKAEDTAVYYCEREGG VSNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKSCDKTHTC |
| SEQ ID NO: 179 | Cys-Pro-Pro-Cys-Modified AFD.v14 Heavy Chain | EVQLVQSGPELKKPGASVKVSCKASGYTFTNYGMNWVRQAPGQGLEWMG WINTYTGETTYAEDFKGRFVFSLDTSVSTAYLQISSLKAEDTAVYYCEREGG VSNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKSCDKTHTCPPC |

While Fab, Fab', Fab-C and F(ab')2 fragments provide the advantage of small size, short serum half-life, and lack of effector function, they typically include parts of the upper hinge region that can serve as neoepitopes, and are eventually recognized by the immune system and anti-hinge antibodies (AHA) are generated. These pre-existing AHA titers vary from donor to donor and may represent past and current exposure to neoepitopes. AHA can act as surrogate Fc and restore effector function of proteolytically inactivated antibodies. One reason to use a Fab, Fab', Fab-C or F(ab')2 molecule as therapeutic format is to eliminate effector function. Thus, it is undesired to have effector function reinstated by pre-existing AHA and risk any potential safety concerns. To evade recognition by pre-existing AHAs, the Fab, Fab', Fab-C or F(ab')2 fragments of an IgG2 or IgG4 isotype can be used. Alternatively, the heavy chain of the Fab of an IgG1 isotype can be modified to terminate with Cys-Asp or Cys-Asp-Lys-Thr-His-Leu.

In specific embodiments, the anti-Factor D antibody is a Fab fragment, a Fab' fragment, a Fab-C fragment or a Cys-Asp-Lys-Thr-His-X (CDKTHX), wherein X is any amino acid except Thr (T). The cysteine residue(s) may be attached to a polymer (e.g., a PEG polymer). In specific embodiments, the anti-Factor D antibody is a Fab fragment of an IgG1 isotype.

In specific embodiments, the anti-Factor D antibody is a Fab-C fragment whose C-terminal of the heavy chain is modified to terminate with Cys-Asp-Lys-Thr-His-Thr-Cys (CDKTHTC). In specific embodiments, the anti-Factor D antibody is a Fab fragment, a Fab' fragment or a F(ab')2 fragment whose C-terminal of the heavy chain is modified to terminate with Cys-Asp-Lys-Thr-His-Thr-Cys-Pro-Pro-Cys (CDKTHTCPPC), Cys-Asp-Lys-Thr-His-Thr-Cys-Pro-Pro-Ser (CDKTHTCPPS), Cys-Asp-Lys-Thr-His-Thr-Ser-Pro-Pro-Cys (CDKTHTSPPC), Cys-Asp-Lys-Thr-His-Thr-Ala-Pro-Pro-Cys (CDKTHTAPPC), or Cys-Asp-Lys-Thr-His-Thr-Ser-Gly-Gly-Cys (CDKTHTSGGC). In specific embodiments, the anti-Factor D antibody is a Fab fragment whose C-terminal of the heavy chain is modified to terminate with Cys-Tyr-Gly-Pro-Pro-Cys (CYGPPC). One, two, or three of the cysteine residue(s) (as the case may be) may each be attached to a polymer (e.g., a PEG polymer). In specific embodiments, the anti-Factor D antibody is a Fab fragment, a Fab' fragment, a Fab-C fragment or a F(ab')2 fragment of an IgG1 isotype.

In specific embodiments, the anti-Factor D antibody is a Fab fragment whose C-terminal of the heavy chain is modified to terminate with Val-Glu-Arg-Lys (VERK). In specific embodiments, the anti-Factor D antibody is a Fab-C fragment whose C-terminal of the heavy chain is modified to terminate with Val-Glu-Arg-Lys-Cys (VERKC). The cysteine residue may be attached to a polymer (e.g., a PEG polymer). In specific embodiments, the anti-Factor D antibody is a Fab fragment or a Fab-C fragment of an IgG2 isotype.

In specific embodiments, the anti-Factor D antibody is a Fab fragment whose C-terminal of the heavy chain is modified to terminate with Lys-Tyr-Gly-Pro-Pro (KYGPP), Lys-Tyr-Gly-Pro (KYGP), Lys-Tyr-Gly (KYG), Lys-Tyr (KY), or Lys (K). In specific embodiments, the anti-Factor D antibody is a Fab-C fragment whose C-terminal of the heavy chain is modified to terminate with Lys-Tyr-Gly-Pro-Pro-Cys (KYGPPC). The cysteine residue may be attached to a polymer (e.g., a PEG polymer). In specific embodiments, the anti-Factor D antibody is a Fab fragmentor a Fab-C fragment of an IgG4 isotype.

In some embodiments, the anti-Factor D antibody is a Fab fragment comprising a heavy chain having the amino acid sequence of SEQ ID NO: 180, SEQ ID NO: 181, SEQ ID NO: 182, SEQ ID NO: 183, SEQ ID NO: 184, SEQ ID NO: 185, SEQ ID NO: 186, SEQ ID NO: 187, SEQ ID NO: 188, SEQ ID NO: 189, SEQ ID NO: 190, SEQ ID NO: 191, SEQ ID NO: 192, SEQ ID NO: 193, SEQ ID NO: 194, SEQ ID NO: 195, SEQ ID NO: 196, SEQ ID NO: 197, SEQ ID NO: 198, SEQ ID NO: 199, SEQ ID NO: 200, SEQ ID NO: 201, SEQ ID NO: 202, SEQ ID NO: 203, SEQ ID NO: 204, SEQ ID NO: 205, SEQ ID NO: 206, SEQ ID NO: 207, SEQ ID NO: 208, SEQ ID NO: 209, SEQ ID NO: 210, SEQ ID NO: 211, SEQ ID NO: 212, or SEQ ID NO: 213. In some embodiments, the anti-Factor D antibody is a Fab fragment comprising a heavy chain having at least 90% sequence identity to the amino acid sequence of SEQ ID NO: 180, SEQ ID NO: 181, SEQ ID NO: 182, SEQ ID NO: 183, SEQ ID NO: 184, SEQ ID NO: 185, SEQ ID NO: 186, SEQ ID NO: 187, SEQ ID NO: 188, SEQ ID NO: 189, SEQ ID NO: 190, SEQ ID NO: 191, SEQ ID NO: 192, SEQ ID NO: 193, SEQ ID NO: 194, SEQ ID NO: 195, SEQ ID NO: 196, SEQ ID NO: 197, SEQ ID NO: 198, SEQ ID NO: 199, SEQ ID NO: 200, SEQ ID NO: 201, SEQ ID NO: 202, SEQ ID NO: 203, SEQ ID NO: 204, SEQ ID NO: 205, SEQ ID NO: 206, SEQ ID NO: 207, SEQ ID NO: 208, SEQ ID NO: 209, SEQ ID NO: 210, SEQ ID NO: 211, SEQ ID NO: 212, or SEQ ID NO: 213. See Table 8. In specific embodiments, the Fab fragment is of an IgG1 isotype. In specific embodiments, the cysteine in the Cys-Asp (CD) sequence at the C' Terminal end is attached to a polymer (e.g., a PEG polymer).

In some embodiments, the anti-Factor D antibody is a Fab fragment comprising a heavy chain having the amino acid sequence of SEQ ID NO: 214, SEQ ID NO: 215, SEQ ID NO: 216, SEQ ID NO: 217, SEQ ID NO: 218, SEQ ID NO: 219, SEQ ID NO: 220, SEQ ID NO: 221, SEQ ID NO: 222, SEQ ID NO: 223, SEQ ID NO: 224, SEQ ID NO: 225, SEQ ID NO: 226, SEQ ID NO: 227, SEQ ID NO: 228, SEQ ID NO: 229, SEQ ID NO: 230, SEQ ID NO: 231, SEQ ID NO: 232, SEQ ID NO: 233, SEQ ID NO: 234, SEQ ID NO: 235, SEQ ID NO: 236, SEQ ID NO: 237, SEQ ID NO: 238, SEQ ID NO: 239, SEQ ID NO: 240, SEQ ID NO: 241, SEQ ID NO: 242, SEQ ID NO: 243, SEQ ID NO: 244, SEQ ID NO: 245, SEQ ID NO: 246, or SEQ ID NO: 247. In some embodiments, the anti-Factor D antibody is a Fab fragment comprising a heavy chain having at least 90% sequence identity to the amino acid sequence of SEQ ID NO: 214, SEQ ID NO: 215, SEQ ID NO: 216, SEQ ID NO: 217, SEQ ID NO: 218, SEQ ID NO: 219, SEQ ID NO: 220, SEQ ID NO: 221, SEQ ID NO: 222, SEQ ID NO: 223, SEQ ID NO: 224, SEQ ID NO: 225, SEQ ID NO: 226, SEQ ID NO: 227, SEQ ID NO: 228, SEQ ID NO: 229, SEQ ID NO: 230, SEQ ID NO: 231, SEQ ID NO: 232, SEQ ID NO: 233, SEQ ID NO: 234, SEQ ID NO: 235, SEQ ID NO: 236, SEQ ID NO: 237, SEQ ID NO: 238, SEQ ID NO: 239, SEQ ID NO: 240, SEQ ID NO: 241, SEQ ID NO: 242, SEQ ID NO: 243, SEQ ID NO: 244, SEQ ID NO: 245, SEQ ID NO: 246, or SEQ ID NO: 247. See Table 8. In specific embodiments, the Fab fragment is of an IgG1 isotype. In specific embodiments, the cysteine in the Cys-Asp-Lys-Thr-His-Leu (CDKTHL) sequence at the C' Terminal end is attached to a polymer (e.g., a PEG polymer).

In some embodiments, the anti-Factor D antibody is a Fab fragment comprising a heavy chain having the amino acid sequence of SEQ ID NO: 248, SEQ ID NO: 249, SEQ ID NO: 250, SEQ ID NO: 251, SEQ ID NO: 252, SEQ ID NO: 253, SEQ ID NO: 254, SEQ ID NO: 255, SEQ ID NO: 256, SEQ ID NO: 257, SEQ ID NO: 258, SEQ ID NO: 259, SEQ ID NO: 260, SEQ ID NO: 261, SEQ ID NO: 262, SEQ ID NO: 263, SEQ ID NO: 264, SEQ ID NO: 265, SEQ ID NO: 266, SEQ ID NO: 267, SEQ ID NO: 268, SEQ ID NO: 269, SEQ ID NO: 270, SEQ ID NO: 271, SEQ ID NO: 272, SEQ ID NO: 273, SEQ ID NO: 274, SEQ ID NO: 275, SEQ ID NO: 276, SEQ ID NO: 277, SEQ ID NO: 278, SEQ ID NO: 279, SEQ ID NO: 280, or SEQ ID NO: 281. In some embodiments, the anti-Factor D antibody is a Fab fragment comprising a heavy chain having at least 90% sequence identity to the amino acid sequence of SEQ ID NO: 248, SEQ ID NO: 249, SEQ ID NO: 250, SEQ ID NO: 251, SEQ ID NO: 252, SEQ ID NO: 253, SEQ ID NO: 254, SEQ ID NO: 255, SEQ ID NO: 256, SEQ ID NO: 257, SEQ ID NO: 258, SEQ ID NO: 259, SEQ ID NO: 260, SEQ ID NO: 261, SEQ ID NO: 262, SEQ ID NO: 263, SEQ ID NO: 264, SEQ ID NO: 265, SEQ ID NO: 266, SEQ ID NO: 267, SEQ ID NO: 268, SEQ ID NO: 269, SEQ ID NO: 270, SEQ ID NO: 271, SEQ ID NO: 272, SEQ ID NO: 273, SEQ ID NO: 274, SEQ ID NO: 275, SEQ ID NO: 276, SEQ ID NO: 277, SEQ ID NO: 278, SEQ ID NO: 279, SEQ ID NO: 280, or SEQ ID NO: 281. See Table 8. In specific embodiments, the Fab fragment is of an IgG1 isotype. In specific embodiments, the cysteine in the Cys-Asp-Lys (CDK) sequence at the C' Terminal end is attached to a polymer (e.g., a PEG polymer).

In some embodiments, the anti-Factor D antibody is a Fab fragment comprising a heavy chain having the amino acid sequence of SEQ ID NO: 282, SEQ ID NO: 283, SEQ ID NO: 284, SEQ ID NO: 285, SEQ ID NO: 286, SEQ ID NO: 287, SEQ ID NO: 288, SEQ ID NO: 289, SEQ ID NO: 290, SEQ ID NO: 291, SEQ ID NO: 292, SEQ ID NO: 293, SEQ ID NO: 294, SEQ ID NO: 295, SEQ ID NO: 296, SEQ ID NO: 297, SEQ ID NO: 298, SEQ ID NO: 299, SEQ ID NO: 300, SEQ ID NO: 301, SEQ ID NO: 302, SEQ ID NO: 303, SEQ ID NO: 304, SEQ ID NO: 305, SEQ ID NO: 306, SEQ ID NO: 307, SEQ ID NO: 308, SEQ ID NO: 309, SEQ ID NO: 310, SEQ ID NO: 311, SEQ ID NO: 312, SEQ ID NO: 313, SEQ ID NO: 314, or SEQ ID NO: 315. In some embodiments, the anti-Factor D antibody is a Fab fragment comprising a heavy chain having at least 90% sequence identity to the amino acid sequence of SEQ ID NO: 282, SEQ ID NO: 283, SEQ ID NO: 284, SEQ ID NO: 285, SEQ ID NO: 286, SEQ ID NO: 287, SEQ ID NO: 288, SEQ ID NO: 289, SEQ ID NO: 290, SEQ ID NO: 291, SEQ ID NO: 292, SEQ ID NO: 293, SEQ ID NO: 294, SEQ ID NO: 295, SEQ ID NO: 296, SEQ ID NO: 297, SEQ ID NO: 298, SEQ ID NO: 299, SEQ ID NO: 300, SEQ ID NO: 301, SEQ ID NO: 302, SEQ ID NO: 303, SEQ ID NO: 304, SEQ ID NO: 305, SEQ ID NO: 306, SEQ ID NO: 307, SEQ ID NO: 308, SEQ ID NO: 309, SEQ ID NO: 310, SEQ ID NO: 311, SEQ ID NO: 312, SEQ ID NO: 313, SEQ ID NO: 314, or SEQ ID NO: 315. See Table 8. In specific embodiments, the Fab fragment is of an IgG1 isotype. In specific embodiments, the cysteine in the Cys-Asp-Lys-Thr (CDKT) sequence at the C' Terminal end is attached to a polymer (e.g., a PEG polymer).

In some embodiments, the anti-Factor D antibody is a Fab fragment comprising a heavy chain having the amino acid sequence of SEQ ID NO: 316, SEQ ID NO: 317, SEQ ID NO: 318, SEQ ID NO: 319, SEQ ID NO: 320, SEQ ID NO: 321, SEQ ID NO: 322, SEQ ID NO: 323, SEQ ID NO: 324, SEQ ID NO: 325, SEQ ID NO: 326, SEQ ID NO: 327, SEQ ID NO: 328, SEQ ID NO: 329, SEQ ID NO: 330, SEQ ID NO: 331, SEQ ID NO: 332, SEQ ID NO: 333, SEQ ID NO: 334, SEQ ID NO: 335, SEQ ID NO: 336, SEQ ID NO: 337, SEQ ID NO: 338, SEQ ID NO: 339, SEQ ID NO: 340, SEQ ID NO: 341, SEQ ID NO: 342, SEQ ID NO: 343, SEQ ID NO: 344, SEQ ID NO: 345, SEQ ID NO: 346, SEQ ID NO: 347, SEQ ID NO: 348, or SEQ ID NO: 349. In some embodiments, the anti-Factor D antibody is a Fab fragment comprising a heavy chain having at least 90% sequence identity to the amino acid sequence of SEQ ID NO: 316, SEQ ID NO: 317, SEQ ID NO: 318, SEQ ID NO: 319, SEQ ID NO: 320, SEQ ID NO: 321, SEQ ID NO: 322, SEQ ID NO: 323, SEQ ID NO: 324, SEQ ID NO: 325, SEQ ID NO: 326, SEQ ID NO: 327, SEQ ID NO: 328, SEQ ID NO: 329, SEQ ID NO: 330, SEQ ID NO: 331, SEQ ID NO: 332, SEQ ID NO: 333, SEQ ID NO: 334, SEQ ID NO: 335, SEQ ID NO: 336, SEQ ID NO: 337, SEQ ID NO: 338, SEQ ID NO: 339, SEQ ID NO: 340, SEQ ID NO: 341, SEQ ID NO: 342, SEQ ID NO: 343, SEQ ID NO: 344, SEQ ID NO: 345, SEQ ID NO: 346, SEQ ID NO: 347, SEQ ID NO: 348, or SEQ ID NO: 349. See Table 8. In specific embodiments, the Fab fragment is of an IgG1 isotype. In specific embodiments, the cysteine in the Cys-Asp-Lys-Thr-His (CDKTH) sequence at the C' Terminal end is attached to a polymer (e.g., a PEG polymer).

In some embodiments, the anti-Factor D antibody is a Fab-C fragment comprising a heavy chain having the amino acid sequence of SEQ ID NO: 350, SEQ ID NO: 351, SEQ ID NO: 352, SEQ ID NO: 353, SEQ ID NO: 354, SEQ ID NO: 355, SEQ ID NO: 356, SEQ ID NO: 357, SEQ ID NO: 358, SEQ ID NO: 359, SEQ ID NO: 360, SEQ ID NO: 361, SEQ ID NO: 362, SEQ ID NO: 363, SEQ ID NO: 364, SEQ ID NO: 365, SEQ ID NO: 366, SEQ ID NO: 367, SEQ ID NO: 368, SEQ ID NO: 369, SEQ ID NO: 370, SEQ ID NO: 371, SEQ ID NO: 372, SEQ ID NO: 373, SEQ ID NO: 374, SEQ ID NO: 375, SEQ ID NO: 376, SEQ ID NO: 377, SEQ ID NO: 378, SEQ ID NO: 379, SEQ ID NO: 380, SEQ ID NO: 381, SEQ ID NO: 382, or SEQ ID NO: 383. In some embodiments, the anti-Factor D antibody is a Fab-C fragment comprising a heavy chain having at least 90% sequence identity to the amino acid sequence of SEQ ID NO: 350, SEQ ID NO: 351, SEQ ID NO: 352, SEQ ID NO: 353, SEQ ID NO: 354, SEQ ID NO: 355, SEQ ID NO: 356, SEQ ID NO: 357, SEQ ID NO: 358, SEQ ID NO: 359, SEQ ID NO: 360, SEQ ID NO: 361, SEQ ID NO: 362, SEQ ID NO: 363, SEQ ID NO: 364, SEQ ID NO: 365, SEQ ID NO: 366, SEQ ID NO: 367, SEQ ID NO: 368, SEQ ID NO: 369, SEQ ID NO: 370, SEQ ID NO: 371, SEQ ID NO: 372, SEQ ID NO: 373, SEQ ID NO: 374, SEQ ID NO: 375, SEQ ID NO: 376, SEQ ID NO: 377, SEQ ID NO: 378, SEQ ID NO: 379, SEQ ID NO: 380, SEQ ID NO: 381, SEQ ID NO: 382, or SEQ ID NO: 383. See Table 8. In specific embodiments, the Fab-C fragment is of an IgG1 isotype. In specific embodiments, the two cysteines in the Cys-Asp-Lys-Thr-His-Thr-Cys (CDKTHTC) sequence at the C' Terminal end are each attached to a polymer (e.g., a PEG polymer). In specific embodiments, the first cysteine in the Cys-Asp-Lys-Thr-His-Thr-Cys (CDKTHTC) sequence at the C' Terminal end is attached to a polymer (e.g., a PEG polymer). In specific embodiments, the second cysteine in the Cys-Asp-Lys-Thr-His-Thr-Cys (CDKTHTC) sequence at the C' Terminal end is attached to a polymer (e.g., a PEG polymer).

In some embodiments, the anti-Factor D antibody is a Fab fragment, a Fab' fragment or a F(ab')2 fragment comprising a heavy chain having the amino acid sequence of SEQ ID NO: 384, SEQ ID NO: 385, SEQ ID NO: 386, SEQ ID NO: 387, SEQ ID NO: 388, SEQ ID NO: 389, SEQ ID NO: 390, SEQ ID NO: 391, SEQ ID NO: 392, SEQ ID NO: 393, SEQ ID NO: 394, SEQ ID NO: 395, SEQ ID NO: 396, SEQ ID NO: 397, SEQ ID NO: 398, SEQ ID NO: 399, SEQ ID NO: 400, SEQ ID NO: 401, SEQ ID NO: 402, SEQ ID NO: 403, SEQ ID NO: 404, SEQ ID NO: 405, SEQ ID NO: 406, SEQ ID NO: 407, SEQ ID NO: 408, SEQ ID NO: 409, SEQ ID NO: 410, SEQ ID NO: 411, SEQ ID NO: 412, SEQ ID NO: 413, SEQ ID NO: 414, SEQ ID NO: 415, SEQ ID NO: 416, or SEQ ID NO: 417. In some embodiments, the anti-Factor D antibody is a Fab fragment, a Fab' fragment or a F(ab')2 fragment comprising a heavy chain having at least 90% sequence identity to the amino acid sequence of SEQ ID NO: 384, SEQ ID NO: 385, SEQ ID NO: 386, SEQ ID NO: 387, SEQ ID NO: 388, SEQ ID NO: 389, SEQ ID NO: 390, SEQ ID NO: 391, SEQ ID NO: 392, SEQ ID NO: 393, SEQ ID NO: 394, SEQ ID NO: 395, SEQ ID NO: 396, SEQ ID NO: 397, SEQ ID NO: 398, SEQ ID NO: 399, SEQ ID NO: 400, SEQ ID NO: 401, SEQ ID NO: 402, SEQ ID NO: 403, SEQ ID NO: 404, SEQ ID NO: 405, SEQ ID NO: 406, SEQ ID NO: 407, SEQ ID NO: 408, SEQ ID NO: 409, SEQ ID NO: 410, SEQ ID NO: 411, SEQ ID NO: 412, SEQ ID NO: 413, SEQ ID NO: 414, SEQ ID NO: 415, SEQ ID NO: 416, or SEQ ID NO: 417. See Table 8. In specific embodiments, the Fab fragment, Fab' fragment or F(ab')2 fragment is of an IgG1 isotype. In specific embodiments, the three cysteines in the Cys-Asp-Lys-Thr-His-Thr-Cys-Pro-Pro-Cys (CDKTH-TCPPC) sequence at the C' Terminal end are each attached to a polymer (e.g., a PEG polymer). In specific embodiments, the second cysteine and the third cysteine in the Cys-Asp-Lys-Thr-His-Thr-Cys-Pro-Pro-Cys (CDKTH-TCPPC) sequence at the C' Terminal end are each attached to a polymer (e.g., a PEG polymer). In specific embodiments, the first cysteine and the third cysteine in the Cys-Asp-Lys-Thr-His-Thr-Cys-Pro-Pro-Cys (CDKTHTCPPC) sequence at the C' Terminal end are each attached to a polymer (e.g., a PEG polymer). In specific embodiments, the first cysteine and the second cysteine in the Cys-Asp-Lys-Thr-His-Thr-Cys-Pro-Pro-Cys (CDKTHTCPPC) sequence at the C' Terminal end are each attached to a polymer (e.g., a PEG polymer). In specific embodiments, the first cysteine in the Cys-Asp-Lys-Thr-His-Thr-Cys-Pro-Pro-Cys (CDK-THTCPPC) sequence at the C' Terminal end is attached to a polymer (e.g., a PEG polymer). In specific embodiments, the second cysteine in the Cys-Asp-Lys-Thr-His-Thr-Cys-Pro-Pro-Cys (CDKTHTCPPC) sequence at the C' Terminal end is attached to a polymer (e.g., a PEG polymer). In specific embodiments, the third cysteine in the Cys-Asp-Lys-Thr- His-Thr-Cys-Pro-Pro-Cys (CDKTHTCPPC) sequence at the C' Terminal end is attached to a polymer (e.g., a PEG polymer).

In some embodiments, the anti-Factor D antibody is a Fab fragment, a Fab' fragment or a F(ab')2 fragment comprising a heavy chain having the amino acid sequence of SEQ ID NO: 418, SEQ ID NO: 419, SEQ ID NO: 420, SEQ ID NO: 421, SEQ ID NO: 422, SEQ ID NO: 423, SEQ ID NO: 424, SEQ ID NO: 425, SEQ ID NO: 426, SEQ ID NO: 427, SEQ ID NO: 428, SEQ ID NO: 429, SEQ ID NO: 430, SEQ ID NO: 431, SEQ ID NO: 432, SEQ ID NO: 433, SEQ ID NO: 434, SEQ ID NO: 435, SEQ ID NO: 436, SEQ ID NO: 437, SEQ ID NO: 438, SEQ ID NO: 439, SEQ ID NO: 440, SEQ ID NO: 441, SEQ ID NO: 442, SEQ ID NO: 443, SEQ ID NO: 444, SEQ ID NO: 445, SEQ ID NO: 446, SEQ ID NO: 447, SEQ ID NO: 448, SEQ ID NO: 449, SEQ ID NO: 450, or SEQ ID NO: 451. In some embodiments, the anti-Factor D antibody is a Fab fragment, a Fab' fragment or a F(ab')2 fragment comprising a heavy chain having at least 90% sequence identity to the amino acid sequence of SEQ ID NO: 418, SEQ ID NO: 419, SEQ ID NO: 420, SEQ ID NO: 421, SEQ ID NO: 422, SEQ ID NO: 423, SEQ ID NO: 424, SEQ ID NO: 425, SEQ ID NO: 426, SEQ ID NO: 427, SEQ ID NO: 428, SEQ ID NO: 429, SEQ ID NO: 430, SEQ ID NO: 431, SEQ ID NO: 432, SEQ ID NO: 433, SEQ ID NO: 434, SEQ ID NO: 435, SEQ ID NO: 436, SEQ ID NO: 437, SEQ ID NO: 438, SEQ ID NO: 439, SEQ ID NO: 440, SEQ ID NO: 441, SEQ ID NO: 442, SEQ ID NO: 443, SEQ ID NO: 444, SEQ ID NO: 445, SEQ ID NO: 446, SEQ ID NO: 447, SEQ ID NO: 448, SEQ ID NO: 449, SEQ ID NO: 450, or SEQ ID NO: 451. See Table 8. In specific embodiments, the Fab fragment, Fab' fragment or F(ab')2 fragment is of an IgG1 isotype. In specific embodiments, the two cysteines in the Cys-Asp-Lys-Thr-His-Thr-Cys-Pro-Pro-Ser (CDKTHTCPPS) sequence at the C' Terminal end are each attached to a polymer (e.g., a PEG polymer). In specific embodiments, the first cysteine in the Cys-Asp-Lys-Thr-His-Thr-Cys-Pro-Pro-Ser (CDKTHTCPPS) sequence at the C' Terminal end is attached to a polymer (e.g., a PEG polymer). In specific embodiments, the second cysteine in the Cys-Asp-Lys-Thr-His-Thr-Cys-Pro-Pro-Ser (CDKTHTCPPS) sequence at the C' Terminal end is attached to a polymer (e.g., a PEG polymer).

In some embodiments, the anti-Factor D antibody is a Fab fragment, a Fab' fragment or a F(ab')2 fragment comprising a heavy chain having the amino acid sequence of SEQ ID NO: 452, SEQ ID NO: 453, SEQ ID NO: 454, SEQ ID NO: 455, SEQ ID NO: 456, SEQ ID NO: 457, SEQ ID NO: 458, SEQ ID NO: 459, SEQ ID NO: 460, SEQ ID NO: 461, SEQ ID NO: 462, SEQ ID NO: 463, SEQ ID NO: 464, SEQ ID NO: 465, SEQ ID NO: 466, SEQ ID NO: 467, SEQ ID NO: 468, SEQ ID NO: 469, SEQ ID NO: 470, SEQ ID NO: 471, SEQ ID NO: 472, SEQ ID NO: 473, SEQ ID NO: 474, SEQ ID NO: 475, SEQ ID NO: 476, SEQ ID NO: 477, SEQ ID NO: 478, SEQ ID NO: 479, SEQ ID NO: 480, SEQ ID NO: 481, SEQ ID NO: 482, SEQ ID NO: 483, SEQ ID NO: 484, or SEQ ID NO: 485. In some embodiments, the anti-Factor D antibody is a Fab fragment, a Fab' fragment or a F(ab')2 fragment comprising a heavy chain having at least 90% sequence identity to the amino acid sequence of SEQ ID NO: 452, SEQ ID NO: 453, SEQ ID NO: 454, SEQ ID NO: 455, SEQ ID NO: 456, SEQ ID NO: 457, SEQ ID NO: 458, SEQ ID NO: 459, SEQ ID NO: 460, SEQ ID NO: 461, SEQ ID NO: 462, SEQ ID NO: 463, SEQ ID NO: 464, SEQ ID NO: 465, SEQ ID NO: 466, SEQ ID NO: 467, SEQ ID NO: 468, SEQ ID NO: 469, SEQ ID NO: 470, SEQ ID NO: 471, SEQ ID NO: 472, SEQ ID NO: 473, SEQ ID NO: 474, SEQ ID NO: 475, SEQ ID NO: 476, SEQ ID NO: 477, SEQ ID NO: 478, SEQ ID NO: 479, SEQ ID NO: 480, SEQ ID NO: 481, SEQ ID NO: 482, SEQ ID NO: 483, SEQ ID NO: 484, or SEQ ID NO: 485. See Table 8. In specific embodiments, the Fab fragment, Fab' fragment or F(ab')2 fragment is of an IgG1 isotype. In specific embodiments, the two cysteines in the Cys-Asp-Lys-Thr-His-Thr-Ser-Pro-Pro-Cys (CDKTHTSPPC) sequence at the C' Terminal end are each attached to a polymer (e.g., a PEG polymer). In specific embodiments, the first cysteine in the Cys-Asp-Lys-Thr-His-Thr-Ser-Pro-Pro-Cys (CDKTHTSPPC) sequence at the C' Terminal end is attached to a polymer (e.g., a PEG polymer). In specific embodiments, the second cysteine in the Cys-Asp-Lys-Thr-His-Thr-Ser-Pro-Pro-Cys (CDKTHTSPPC) sequence at the C' Terminal end is attached to a polymer (e.g., a PEG polymer).

In some embodiments, the anti-Factor D antibody is a Fab fragment, a Fab' fragment or a F(ab')2 fragment comprising a heavy chain having the amino acid sequence of SEQ ID NO: 486, SEQ ID NO: 487, SEQ ID NO: 488, SEQ ID NO: 489, SEQ ID NO: 490, SEQ ID NO: 491, SEQ ID NO: 492, SEQ ID NO: 493, SEQ ID NO: 494, SEQ ID NO: 495, SEQ ID NO: 496, SEQ ID NO: 497, SEQ ID NO: 498, SEQ ID NO: 499, SEQ ID NO: 500, SEQ ID NO: 501, SEQ ID NO: 502, SEQ ID NO: 503, SEQ ID NO: 504, SEQ ID NO: 505, SEQ ID NO: 506, SEQ ID NO: 507, SEQ ID NO: 508, SEQ ID NO: 509, SEQ ID NO: 510, SEQ ID NO: 511, SEQ ID NO: 512, SEQ ID NO: 513, SEQ ID NO: 514, SEQ ID NO: 515, SEQ ID NO: 516, SEQ ID NO: 517, SEQ ID NO: 518, or SEQ ID NO: 519. In some embodiments, the anti-Factor D antibody is a Fab fragment, a Fab' fragment or a F(ab')2 fragment comprising a heavy chain having at least 90% sequence identity to the amino acid sequence of SEQ ID NO: 486, SEQ ID NO: 487, SEQ ID NO: 488, SEQ ID NO: 489, SEQ ID NO: 490, SEQ ID NO: 491, SEQ ID NO: 492, SEQ ID NO: 493, SEQ ID NO: 494, SEQ ID NO: 495, SEQ ID NO: 496, SEQ ID NO: 497, SEQ ID NO: 498, SEQ ID NO: 499, SEQ ID NO: 500, SEQ ID NO: 501, SEQ ID NO: 502, SEQ ID NO: 503, SEQ ID NO: 504, SEQ ID NO: 505, SEQ ID NO: 506, SEQ ID NO: 507, SEQ ID NO: 508, SEQ ID NO: 509, SEQ ID NO: 510, SEQ ID NO: 511, SEQ ID NO: 512, SEQ ID NO: 513, SEQ ID NO: 514, SEQ ID NO: 515, SEQ ID NO: 516, SEQ ID NO: 517, SEQ ID NO: 518, or SEQ ID NO: 519. See Table 8. In specific embodiments, the Fab fragment, Fab' fragment or F(ab')2 fragment is of an IgG1 isotype. In specific embodiments, the two cysteines in the Cys-Asp-Lys-Thr-His-Thr-Ala-Pro-Pro-Cys (CDKTHTAPPC) sequence at the C' Terminal end are each attached to a polymer (e.g., a PEG polymer). In specific embodiments, the first cysteine in the Cys-Asp-Lys-Thr-His-Thr-Ala-Pro-Pro-Cys (CDKTHTAPPC) sequence at the C' Terminal end is attached to a polymer (e.g., a PEG polymer). In specific embodiments, the second cysteine in the Cys-Asp-Lys-Thr-His-Thr-Ala-Pro-Pro-Cys (CDKTHTAPPC) sequence at the C' Terminal end is attached to a polymer (e.g., a PEG polymer).

In some embodiments, the anti-Factor D antibody is a Fab fragment, a Fab' fragment or a F(ab')2 fragment comprising a heavy chain having the amino acid sequence of SEQ ID NO: 520, SEQ ID NO: 521, SEQ ID NO: 522, SEQ ID NO: 523, SEQ ID NO: 524, SEQ ID NO: 525, SEQ ID NO: 526, SEQ ID NO: 527, SEQ ID NO: 528, SEQ ID NO: 529, SEQ ID NO: 530, SEQ ID NO: 531, SEQ ID NO: 532, SEQ ID NO: 533, SEQ ID NO: 534, SEQ ID NO: 535, SEQ ID NO: 536, SEQ ID NO: 537, SEQ ID NO: 538, SEQ ID NO: 539, SEQ ID NO: 540, SEQ ID NO: 541, SEQ ID NO: 542, SEQ ID NO: 543, SEQ ID NO: 544, SEQ ID NO: 545, SEQ ID NO: 546, SEQ ID NO: 547, SEQ ID NO: 548, SEQ ID NO: 549, SEQ ID NO: 550, SEQ ID NO: 551, SEQ ID NO: 552, or SEQ ID NO: 553. In some embodiments, the anti-Factor D antibody is a Fab fragment, a Fab' fragment or a F(ab')2 fragment comprising a heavy chain having at least 90% sequence identity to the amino acid sequence of SEQ ID NO: 520, SEQ ID NO: 521, SEQ ID NO: 522, SEQ ID NO: 523, SEQ ID NO: 524, SEQ ID NO: 525, SEQ ID NO: 526, SEQ ID NO: 527, SEQ ID NO: 528, SEQ ID NO: 529, SEQ ID NO: 530, SEQ ID NO: 531, SEQ ID NO: 532, SEQ ID NO: 533, SEQ ID NO: 534, SEQ ID NO: 535, SEQ ID NO: 536, SEQ ID NO: 537, SEQ ID NO: 538, SEQ ID NO: 539, SEQ ID NO: 540, SEQ ID NO: 541, SEQ ID NO: 542, SEQ ID NO: 543, SEQ ID NO: 544, SEQ ID NO: 545, SEQ ID NO: 546, SEQ ID NO: 547, SEQ ID NO: 548, SEQ ID NO: 549, SEQ ID NO: 550, SEQ ID NO: 551, SEQ ID NO: 552, or SEQ ID NO: 553. See Table 8. In specific embodiments, the Fab fragment, Fab' fragment or F(ab')2 fragment is of an IgG1 isotype. In specific embodiments, the two cysteines in the Cys-Asp-Lys-Thr-His-Thr-Ser-Gly-Gly-Cys (CDKTHTSGGC) sequence at the C' Terminal end are each attached to a polymer (e.g., a PEG polymer). In specific embodiments, the first cysteine in the Cys-Asp-Lys-Thr-His-Thr-Ser-Gly-Gly-Cys (CDKTHTSGGC) sequence at the C' Terminal end is attached to a polymer (e.g., a PEG polymer). In specific embodiments, the second cysteine in the Cys-Asp-Lys-Thr-His-Thr-Ser-Gly-Gly-Cys (CDKTHTSGGC) sequence at the C' Terminal end is attached to a polymer (e.g., a PEG polymer).

In some embodiments, the anti-Factor D antibody is a Fab fragment comprising a heavy chain having the amino acid sequence of SEQ ID NO: 554, SEQ ID NO: 555, SEQ ID NO: 556, SEQ ID NO: 557, SEQ ID NO: 558, SEQ ID NO: 559, SEQ ID NO: 560, SEQ ID NO: 561, SEQ ID NO: 562, SEQ ID NO: 563, SEQ ID NO: 564, SEQ ID NO: 565, SEQ ID NO: 566, SEQ ID NO: 567, SEQ ID NO: 568, SEQ ID NO: 569, SEQ ID NO: 570, SEQ ID NO: 571, SEQ ID NO: 572, SEQ ID NO: 573, SEQ ID NO: 574, SEQ ID NO: 575, SEQ ID NO: 576, SEQ ID NO: 577, SEQ ID NO: 578, SEQ ID NO: 579, SEQ ID NO: 580, SEQ ID NO: 581, SEQ ID NO: 582, SEQ ID NO: 583, SEQ ID NO: 584, SEQ ID NO: 585, SEQ ID NO: 586, or SEQ ID NO: 587. In some embodiments, the anti-Factor D antibody is a Fab fragment comprising a heavy chain having at least 90% sequence identity to the amino acid sequence of SEQ ID NO: 554, SEQ ID NO: 555, SEQ ID NO: 556, SEQ ID NO: 557, SEQ ID NO: 558, SEQ ID NO: 559, SEQ ID NO: 560, SEQ ID NO: 561, SEQ ID NO: 562, SEQ ID NO: 563, SEQ ID NO: 564, SEQ ID NO: 565, SEQ ID NO: 566, SEQ ID NO: 567, SEQ ID NO: 568, SEQ ID NO: 569, SEQ ID NO: 570, SEQ ID NO: 571, SEQ ID NO: 572, SEQ ID NO: 573, SEQ ID NO: 574, SEQ ID NO: 575, SEQ ID NO: 576, SEQ ID NO: 577, SEQ ID NO: 578, SEQ ID NO: 579, SEQ ID NO: 580, SEQ ID NO: 581, SEQ ID NO: 582, SEQ ID NO: 583, SEQ ID NO: 584, SEQ ID NO: 585, SEQ ID NO: 586, or SEQ ID NO: 587. See Table 8. In specific embodiments, the Fab fragment is of an IgG1 isotype. In specific embodiments, the two cysteines in the Cys-Tyr-Gly-Pro-Pro-Cys (CYGPPC) sequence at the C' Terminal end are each attached to a polymer (e.g., a PEG polymer). In specific embodiments, the first cysteine in the Cys-Tyr-Gly-Pro-Pro-Cys (CYGPPC) sequence at the C' Terminal end is attached to a polymer (e.g., a PEG polymer). In specific embodiments, the second cysteine in the Cys-Tyr-Gly-Pro-Pro-Cys (CYGPPC) sequence at the C' Terminal end is attached to a polymer (e.g., a PEG polymer).

In some embodiments, the anti-Factor D antibody is a Fab fragment comprising a heavy chain having the amino acid sequence of SEQ ID NO: 588, SEQ ID NO: 589, SEQ ID NO: 590, SEQ ID NO: 591, SEQ ID NO: 592, SEQ ID NO: 593, SEQ ID NO: 594, SEQ ID NO: 595, SEQ ID NO: 596, SEQ ID NO: 597, SEQ ID NO: 598, SEQ ID NO: 599, SEQ ID NO: 600, SEQ ID NO: 601, SEQ ID NO: 602, SEQ ID NO: 603, SEQ ID NO: 604, SEQ ID NO: 605, SEQ ID NO: 606, SEQ ID NO: 607, SEQ ID NO: 608, SEQ ID NO: 609, SEQ ID NO: 610, SEQ ID NO: 611, SEQ ID NO: 612, SEQ ID NO: 613, SEQ ID NO: 614, SEQ ID NO: 615, SEQ ID NO: 616, SEQ ID NO: 617, SEQ ID NO: 618, SEQ ID NO: 619, SEQ ID NO: 620, or SEQ ID NO: 621. In some embodiments, the anti-Factor D antibody is a Fab fragment comprising a heavy chain having at least 90% sequence identity to the amino acid sequence of SEQ ID NO: 588, SEQ ID NO: 589, SEQ ID NO: 590, SEQ ID NO: 591, SEQ ID NO: 592, SEQ ID NO: 593, SEQ ID NO: 594, SEQ ID NO: 595, SEQ ID NO: 596, SEQ ID NO: 597, SEQ ID NO: 598, SEQ ID NO: 599, SEQ ID NO: 600, SEQ ID NO: 601, SEQ ID NO: 602, SEQ ID NO: 603, SEQ ID NO: 604, SEQ ID NO: 605, SEQ ID NO: 606, SEQ ID NO: 607, SEQ ID NO: 608, SEQ ID NO: 609, SEQ ID NO: 610, SEQ ID NO: 611, SEQ ID NO: 612, SEQ ID NO: 613, SEQ ID NO: 614, SEQ ID NO: 615, SEQ ID NO: 616, SEQ ID NO: 617, SEQ ID NO: 618, SEQ ID NO: 619, SEQ ID NO: 620, or SEQ ID NO: 621. See Table 8. In specific embodiments, the Fab fragment is of an IgG2 isotype.

In some embodiments, the anti-Factor D antibody is a Fab-C fragment comprising a heavy chain having the amino acid sequence of SEQ ID NO: 622, SEQ ID NO: 623, SEQ ID NO: 624, SEQ ID NO: 625, SEQ ID NO: 626, SEQ ID NO: 627, SEQ ID NO: 628, SEQ ID NO: 629, SEQ ID NO: 630, SEQ ID NO: 631, SEQ ID NO: 632, SEQ ID NO: 633, SEQ ID NO: 634, SEQ ID NO: 635, SEQ ID NO: 636, SEQ ID NO: 637, SEQ ID NO: 638, SEQ ID NO: 639, SEQ ID NO: 640, SEQ ID NO: 641, SEQ ID NO: 642, SEQ ID NO: 643, SEQ ID NO: 644, SEQ ID NO: 645, SEQ ID NO: 646, SEQ ID NO: 647, SEQ ID NO: 648, SEQ ID NO: 649, SEQ ID NO: 650, SEQ ID NO: 651, SEQ ID NO: 652, SEQ ID NO: 653, SEQ ID NO: 654, or SEQ ID NO: 655. In some embodiments, the anti-Factor D antibody is a Fab-C fragment comprising a heavy chain having at least 90% sequence identity to the amino acid sequence of SEQ ID NO: 622, SEQ ID NO: 623, SEQ ID NO: 624, SEQ ID NO: 625, SEQ ID NO: 626, SEQ ID NO: 627, SEQ ID NO: 628, SEQ ID NO: 629, SEQ ID NO: 630, SEQ ID NO: 631, SEQ ID NO: 632, SEQ ID NO: 633, SEQ ID NO: 634, SEQ ID NO: 635, SEQ ID NO: 636, SEQ ID NO: 637, SEQ ID NO: 638, SEQ ID NO: 639, SEQ ID NO: 640, SEQ ID NO: 641, SEQ ID NO: 642, SEQ ID NO: 643, SEQ ID NO: 644, SEQ ID NO: 645, SEQ ID NO: 646, SEQ ID NO: 647, SEQ ID NO: 648, SEQ ID NO: 649, SEQ ID NO: 650, SEQ ID NO: 651, SEQ ID NO: 652, SEQ ID NO: 653, SEQ ID NO: 654, or SEQ ID NO: 655. See Table 8. In specific embodiments, the Fab-C fragment is of an IgG2 isotype. In specific embodiments, the cysteine in the Val-Glu-Arg-Lys-Cys (VERKC) sequence at the C' Terminal end is attached to a polymer (e.g., a PEG polymer).

In some embodiments, the anti-Factor D antibody is a Fab-C fragment comprising a heavy chain having the amino acid sequence of SEQ ID NO: 656, SEQ ID NO: 657, SEQ ID NO: 658, SEQ ID NO: 659, SEQ ID NO: 660, SEQ ID NO: 661, SEQ ID NO: 662, SEQ ID NO: 663, SEQ ID NO: 664, SEQ ID NO: 665, SEQ ID NO: 666, SEQ ID NO: 667, SEQ ID NO: 668, SEQ ID NO: 669, SEQ ID NO: 670, SEQ ID NO: 671, SEQ ID NO: 672, SEQ ID NO: 673, SEQ ID NO: 674, SEQ ID NO: 675, SEQ ID NO: 676, SEQ ID NO: 677, SEQ ID NO: 678, SEQ ID NO: 679, SEQ ID NO: 680, SEQ ID NO: 681, SEQ ID NO: 682, SEQ ID NO: 683, SEQ ID NO: 684, SEQ ID NO: 685, SEQ ID NO: 686, SEQ ID NO: 687, SEQ ID NO: 688, or SEQ ID NO: 689. In some embodiments, the anti-Factor D antibody is a Fab-C fragment comprising a heavy chain having at least 90% sequence identity to the amino acid sequence of SEQ ID NO: 656, SEQ ID NO: 657, SEQ ID NO: 658, SEQ ID NO: 659, SEQ ID NO: 660, SEQ ID NO: 661, SEQ ID NO: 662, SEQ ID NO: 663, SEQ ID NO: 664, SEQ ID NO: 665, SEQ ID NO: 666, SEQ ID NO: 667, SEQ ID NO: 668, SEQ ID NO: 669, SEQ ID NO: 670, SEQ ID NO: 671, SEQ ID NO: 672, SEQ ID NO: 673, SEQ ID NO: 674, SEQ ID NO: 675, SEQ ID NO: 676, SEQ ID NO: 677, SEQ ID NO: 678, SEQ ID NO: 679, SEQ ID NO: 680, SEQ ID NO: 681, SEQ ID NO: 682, SEQ ID NO: 683, SEQ ID NO: 684, SEQ ID NO: 685, SEQ ID NO: 686, SEQ ID NO: 687, SEQ ID NO: 688, or SEQ ID NO: 689. See Table 8. In specific embodiments, the Fab-C fragment is of an IgG4 isotype. In specific embodiments, the cysteine in the Lys-Tyr-Gly-Pro-Pro-Cys (KYGPPC) sequence at the C' Terminal end is attached to a polymer (e.g., a PEG polymer).

In some embodiments, the anti-Factor D antibody is a Fab fragment comprising a heavy chain having the amino acid sequence of SEQ ID NO: 690, SEQ ID NO: 691, SEQ ID NO: 692, SEQ ID NO: 693, SEQ ID NO: 694, SEQ ID NO: 695, SEQ ID NO: 696, SEQ ID NO: 697, SEQ ID NO: 698, SEQ ID NO: 699, SEQ ID NO: 700, SEQ ID NO: 701, SEQ ID NO: 702, SEQ ID NO: 703, SEQ ID NO: 704, SEQ ID NO: 705, SEQ ID NO: 706, SEQ ID NO: 707, SEQ ID NO: 708, SEQ ID NO: 709, SEQ ID NO: 710, SEQ ID NO: 711, SEQ ID NO: 712, SEQ ID NO: 713, SEQ ID NO: 714, SEQ ID NO: 715, SEQ ID NO: 716, SEQ ID NO: 717, SEQ ID NO: 718, SEQ ID NO: 719, SEQ ID NO: 720, SEQ ID NO: 721, SEQ ID NO: 722, or SEQ ID NO: 723. In some embodiments, the anti-Factor D antibody is a Fab fragment comprising a heavy chain having at least 90% sequence identity to the amino acid sequence of SEQ ID NO: 690, SEQ ID NO: 691, SEQ ID NO: 692, SEQ ID NO: 693, SEQ ID NO: 694, SEQ ID NO: 695, SEQ ID NO: 696, SEQ ID NO: 697, SEQ ID NO: 698, SEQ ID NO: 699, SEQ ID NO: 700, SEQ ID NO: 701, SEQ ID NO: 702, SEQ ID NO: 703, SEQ ID NO: 704, SEQ ID NO: 705, SEQ ID NO: 706, SEQ ID NO: 707, SEQ ID NO: 708, SEQ ID NO: 709, SEQ ID NO: 710, SEQ ID NO: 711, SEQ ID NO: 712, SEQ ID NO: 713, SEQ ID NO: 714, SEQ ID NO: 715, SEQ ID NO: 716, SEQ ID NO: 717, SEQ ID NO: 718, SEQ ID NO: 719, SEQ ID NO: 720, SEQ ID NO: 721, SEQ ID NO: 722, or SEQ ID NO: 723. See Table 8. In specific embodiments, the Fab fragment is of an IgG4 isotype.

In some embodiments, the anti-Factor D antibody is a Fab fragment comprising a heavy chain having the amino acid sequence of SEQ ID NO: 724, SEQ ID NO: 725, SEQ ID NO: 726, SEQ ID NO: 727, SEQ ID NO: 728, SEQ ID NO: 729, SEQ ID NO: 730, SEQ ID NO: 731, SEQ ID NO: 732, SEQ ID NO: 733, SEQ ID NO: 734, SEQ ID NO: 735, SEQ ID NO: 736, SEQ ID NO: 737, SEQ ID NO: 738, SEQ ID NO: 739, SEQ ID NO: 740, SEQ ID NO: 741, SEQ ID NO: 742, SEQ ID NO: 743, SEQ ID NO: 744, SEQ ID NO: 745, SEQ ID NO: 746, SEQ ID NO: 747, SEQ ID NO: 748, SEQ ID NO: 749, SEQ ID NO: 750, SEQ ID NO: 751, SEQ ID NO: 752, SEQ ID NO: 753, SEQ ID NO: 754, SEQ ID NO: 755, SEQ ID NO: 756, or SEQ ID NO: 757. In some embodiments, the anti-Factor D antibody is a Fab fragment comprising a heavy chain having at least 90% sequence identity to the amino acid sequence of SEQ ID NO: 724, SEQ ID NO: 725, SEQ ID NO: 726, SEQ ID NO: 727, SEQ ID NO: 728, SEQ ID NO: 729, SEQ ID NO: 730, SEQ ID NO: 731, SEQ ID NO: 732, SEQ ID NO: 733, SEQ ID NO: 734, SEQ ID NO: 735, SEQ ID NO: 736, SEQ ID NO: 737, SEQ ID NO: 738, SEQ ID NO: 739, SEQ ID NO: 740, SEQ ID NO: 741, SEQ ID NO: 742, SEQ ID NO: 743, SEQ ID NO: 744, SEQ ID NO: 745, SEQ ID NO: 746, SEQ ID NO: 747, SEQ ID NO: 748, SEQ ID NO: 749, SEQ ID NO: 750, SEQ ID NO: 751, SEQ ID NO: 752, SEQ ID NO: 753, SEQ ID NO: 754, SEQ ID NO: 755, SEQ ID NO: 756, or SEQ ID NO: 757. See Table 8. In specific embodiments, the Fab fragment is of an IgG4 isotype.

In some embodiments, the anti-Factor D antibody is a Fab fragment comprising a heavy chain having the amino acid sequence of SEQ ID NO: 758, SEQ ID NO: 759, SEQ ID NO: 760, SEQ ID NO: 761, SEQ ID NO: 762, SEQ ID NO: 763, SEQ ID NO: 764, SEQ ID NO: 765, SEQ ID NO: 766, SEQ ID NO: 767, SEQ ID NO: 768, SEQ ID NO: 769, SEQ ID NO: 770, SEQ ID NO: 771, SEQ ID NO: 772, SEQ ID NO: 773, SEQ ID NO: 774, SEQ ID NO: 775, SEQ ID NO: 776, SEQ ID NO: 777, SEQ ID NO: 778, SEQ ID NO: 779, SEQ ID NO: 780, SEQ ID NO: 781, SEQ ID NO: 782, SEQ ID NO: 783, SEQ ID NO: 784, SEQ ID NO: 785, SEQ ID NO: 786, SEQ ID NO: 787, SEQ ID NO: 788, SEQ ID NO: 789, SEQ ID NO: 790, or SEQ ID NO: 791. In some embodiments, the anti-Factor D antibody is a Fab fragment comprising a heavy chain having at least 90% sequence identity to the amino acid sequence of SEQ ID NO: 758, SEQ ID NO: 759, SEQ ID NO: 760, SEQ ID NO: 761, SEQ ID NO: 762, SEQ ID NO: 763, SEQ ID NO: 764, SEQ ID NO: 765, SEQ ID NO: 766, SEQ ID NO: 767, SEQ ID NO: 768, SEQ ID NO: 769, SEQ ID NO: 770, SEQ ID NO: 771, SEQ ID NO: 772, SEQ ID NO: 773, SEQ ID NO: 774, SEQ ID NO: 775, SEQ ID NO: 776, SEQ ID NO: 777, SEQ ID NO: 778, SEQ ID NO: 779, SEQ ID NO: 780, SEQ ID NO: 781, SEQ ID NO: 782, SEQ ID NO: 783, SEQ ID NO: 784, SEQ ID NO: 785, SEQ ID NO: 786, SEQ ID NO: 787, SEQ ID NO: 788, SEQ ID NO: 789, SEQ ID NO: 790, or SEQ ID NO: 791. See Table 8. In specific embodiments, the Fab fragment is of an IgG4 isotype.

In some embodiments, the anti-Factor D antibody is a Fab fragment comprising a heavy chain having the amino acid sequence of SEQ ID NO: 792, SEQ ID NO: 793, SEQ ID NO: 794, SEQ ID NO: 795, SEQ ID NO: 796, SEQ ID NO: 797, SEQ ID NO: 798, SEQ ID NO: 799, SEQ ID NO: 800, SEQ ID NO: 801, SEQ ID NO: 802, SEQ ID NO: 803, SEQ ID NO: 804, SEQ ID NO: 805, SEQ ID NO: 806, SEQ ID NO: 807, SEQ ID NO: 808, SEQ ID NO: 809, SEQ ID NO: 810, SEQ ID NO: 811, SEQ ID NO: 812, SEQ ID NO: 813, SEQ ID NO: 814, SEQ ID NO: 815, SEQ ID NO: 816, SEQ ID NO: 817, SEQ ID NO: 818, SEQ ID NO: 819, SEQ ID NO: 820, SEQ ID NO: 821, SEQ ID NO: 822, SEQ ID NO: 823, SEQ ID NO: 824, or SEQ ID NO: 825. In some embodiments, the anti-Factor D antibody is a Fab fragment comprising a heavy chain having at least 90% sequence identity to the amino acid sequence of SEQ ID NO: 792, SEQ ID NO: 793, SEQ ID NO: 794, SEQ ID NO: 795, SEQ ID NO: 796, SEQ ID NO: 797, SEQ ID NO: 798, SEQ ID NO: 799, SEQ ID NO: 800, SEQ ID NO: 801, SEQ ID NO: 802, SEQ ID NO: 803, SEQ ID NO: 804, SEQ ID NO: 805, SEQ ID NO: 806, SEQ ID NO: 807, SEQ ID NO: 808, SEQ ID NO: 809, SEQ ID NO: 810, SEQ ID NO: 811, SEQ ID NO: 812, SEQ ID NO: 813, SEQ ID NO: 814, SEQ ID NO: 815, SEQ ID NO: 816, SEQ ID NO: 817, SEQ ID NO: 818, SEQ ID NO: 819, SEQ ID NO: 820, SEQ ID NO: 821, SEQ ID NO: 822, SEQ ID NO: 823, SEQ ID NO: 824, or SEQ ID NO: 825. See Table 8. In specific embodiments, the Fab fragment is of an IgG4 isotype.

In some embodiments, the anti-Factor D antibody is a Fab fragment comprising a heavy chain having the amino acid sequence of SEQ ID NO: 826, SEQ ID NO: 827, SEQ ID NO: 828, SEQ ID NO: 829, SEQ ID NO: 830, SEQ ID NO: 831, SEQ ID NO: 832, SEQ ID NO: 833, SEQ ID NO: 834, SEQ ID NO: 835, SEQ ID NO: 836, SEQ ID NO: 837, SEQ ID NO: 838, SEQ ID NO: 839, SEQ ID NO: 840, SEQ ID NO: 841, SEQ ID NO: 842, SEQ ID NO: 843, SEQ ID NO: 844, SEQ ID NO: 845, SEQ ID NO: 846, SEQ ID NO: 847, SEQ ID NO: 848, SEQ ID NO: 849, SEQ ID NO: 850, SEQ ID NO: 851, SEQ ID NO: 852, SEQ ID NO: 853, SEQ ID NO: 854, SEQ ID NO: 855, SEQ ID NO: 856, SEQ ID NO: 857, SEQ ID NO: 858, or SEQ ID NO: 859. In some embodiments, the anti-Factor D antibody is a Fab fragment comprising a heavy chain having at least 90% sequence identity to the amino acid sequence of SEQ ID NO: 792, SEQ ID NO: 826, SEQ ID NO: 827, SEQ ID NO: 828, SEQ ID NO: 829, SEQ ID NO: 830, SEQ ID NO: 831, SEQ ID NO: 832, SEQ ID NO: 833, SEQ ID NO: 834, SEQ ID NO: 835, SEQ ID NO: 836, SEQ ID NO: 837, SEQ ID NO: 838, SEQ ID NO: 839, SEQ ID NO: 840, SEQ ID NO: 841, SEQ ID NO: 842, SEQ ID NO: 843, SEQ ID NO: 844, SEQ ID NO: 845, SEQ ID NO: 846, SEQ ID NO: 847, SEQ ID NO: 848, SEQ ID NO: 849, SEQ ID NO: 850, SEQ ID NO: 851, SEQ ID NO: 852, SEQ ID NO: 853, SEQ ID NO: 854, SEQ ID NO: 855, SEQ ID NO: 856, SEQ ID NO: 857, SEQ ID NO: 858, or SEQ ID NO: 859. See Table 8. In specific embodiments, the Fab fragment is of an IgG4 isotype.

In some embodiments, the anti-Factor D antibody is a Fab fragment comprising a heavy chain having the amino acid sequence of SEQ ID NO: 882, SEQ ID NO: 883, SEQ ID NO: 884, SEQ ID NO: 885, SEQ ID NO: 886, SEQ ID NO: 887, SEQ ID NO: 888, SEQ ID NO: 889, SEQ ID NO: 890, SEQ ID NO: 891, SEQ ID NO: 892, SEQ ID NO: 893, SEQ ID NO: 894, SEQ ID NO: 895, SEQ ID NO: 896, SEQ ID NO: 897, SEQ ID NO: 898, SEQ ID NO: 899, SEQ ID NO: 900, SEQ ID NO: 901, SEQ ID NO: 902, SEQ ID NO: 903, SEQ ID NO: 904, SEQ ID NO: 905, SEQ ID NO: 906, SEQ ID NO: 907, SEQ ID NO: 908, SEQ ID NO: 909, SEQ ID NO: 910, SEQ ID NO: 911, SEQ ID NO: 912, SEQ ID NO: 913, SEQ ID NO: 914, or SEQ ID NO: 915. In some embodiments, the anti-Factor D antibody is a Fab fragment comprising a heavy chain having at least 90% sequence identity to the amino acid sequence of SEQ ID NO: 882, SEQ ID NO: 883, SEQ ID NO: 884, SEQ ID NO: 885, SEQ ID NO: 886, SEQ ID NO: 887, SEQ ID NO: 888, SEQ ID NO: 889, SEQ ID NO: 890, SEQ ID NO: 891, SEQ ID NO: 892, SEQ ID NO: 893, SEQ ID NO: 894, SEQ ID NO: 895, SEQ ID NO: 896, SEQ ID NO: 897, SEQ ID NO: 898, SEQ ID NO: 899, SEQ ID NO: 900, SEQ ID NO: 901, SEQ ID NO: 902, SEQ ID NO: 903, SEQ ID NO: 904, SEQ ID NO: 905, SEQ ID NO: 906, SEQ ID NO: 907, SEQ ID NO: 908, SEQ ID NO: 909, SEQ ID NO: 910, SEQ ID NO: 911, SEQ ID NO: 912, SEQ ID NO: 913, SEQ ID NO: 914, or SEQ ID NO: 915. See Table 8. Here, X in the sequence of CDKTHX is any amino acid except T. In specific embodiments, the Fab fragment is of an IgG1 isotype. In specific embodiments, the cysteine in the Cys-Asp-Lys-Thr-His-Thr-X (CDKTHTX) sequence at the C' Terminal end is attached to a polymer (e.g., a PEG polymer). In specific embodiments, when X is C, the two cysteines in the Cys-Asp-Lys-Thr-His-Thr-X (CDKTHTX) sequence at the C' Terminal end are each attached to a polymer (e.g., a PEG polymer). In specific embodiments, when X is C, the second cysteine in the Cys-Asp-Lys-Thr-His-Thr-X (CDKTHTX) sequence at the C' Terminal end is attached to a polymer (e.g., a PEG polymer).

TABLE 8

Heavy chain and light chain amino acid sequences of C' terminal-modified anti-Factor D antibodies

| SEQ ID NO: 180 | C' terminal-modified AFD WT Heavy Chain | EVQLVQSGPELKKPGASVKVSCKASGYTFTNYGMNWVRQAPGQGLEWMG WINTYTGETTYADDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKSCD |
|---|---|---|
| SEQ ID NO: 181 | C' terminal-modified AFD.v1 Heavy Chain | EVQLVQSGPELKKPGASVKVSCKASGYTFTNYGMNWVRQAPGQGLEWMG WINTYTGETTYADDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKSCD |
| SEQ ID NO: 182 | C' terminal-modified AFD.v2 Heavy Chain | EVQLVQSGPELKKPGASVKVSCKASGYTFTNYGMNWVRQAPGQGLEWMG WINTYTGETTYADDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKSCD |
| SEQ ID NO: 183 | C' terminal-modified AFD.v3 Heavy Chain | EVQLVQSGPELKKPGASVKVSCKASGYTFTNYGMNWVRQAPGQGLEWMG WINTYTGETTYADDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKSCD |
| SEQ ID NO: 184 | C' terminal-modified AFD.v4 Heavy Chain | EVQLVQSGPELKKPGASVKVSCKASGYTFTNYGMNWVRQAPGQGLEWMG WINTYTGETTYADDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKSCD |

TABLE 8-continued

Heavy chain and light chain amino acid sequences of C' terminal-modified anti-Factor D antibodies

| SEQ ID NO: 185 | C' terminal-modified AFD.v5 Heavy Chain | EVQLVQSGPELKKPGASVKVSCKASGYTFTNYGMNWVRQAPGQGLEWMG<br>WINTYTGETTYADDFKGRFVFSLDTSVSTAYLQISSLKAEDTAVYYCEREGG<br>VNNWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKS*CD* |
|---|---|---|
| SEQ ID NO: 186 | C' terminal-modified AFD.v6 Heavy Chain | EVQLVQSGPELKKPGASVKVSCKASGYTFTNYGMNWVRQAPGQGLEWMG<br>WINTYTGETTYAEDFKGRFVFSLDTSVSTAYLQISSLKAEDTAVYYCEREGG<br>VNNWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKS*CD* |
| SEQ ID NO: 187 | C' terminal-modified AFD.v7 Heavy Chain | EVQLVQSGPELKKPGASVKVSCKASGYTFTNYGMNWVRQAPGQGLEWMG<br>WINTYTGETTYAEDFKGRFVFSLDTSVSTAYLQISSLKAEDTAVYYCEREGG<br>VNNWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKS*CD* |
| SEQ ID NO: 188 | C' terminal-modified AFD.v8 Heavy Chain | EVQLVQSGPELKKPGASVKVSCKASGYTFTNYGMNWVRQAPGQGLEWMG<br>WINTYTGETTYAEDFKGRFVFSLDTSVSTAYLQISSLKAEDTAVYYCEREGG<br>VNNWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKS*CD* |
| SEQ ID NO: 189 | C' terminal-modified AFD.v9 Heavy Chain | EVQLVQSGPELKKPGASVKVSCKASGYTFTNYGMNWVRQAPGQGLEWMG<br>WINTYTGETTYAEDFKGRFVFSLDTSVSTAYLQISSLKAEDTAVYYCEREGG<br>VNNWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKS*CD* |
| SEQ ID NO: 190 | C' terminal-modified AFD.v10 Heavy Chain | EVQLVQSGPELKKPGASVKVSCKASGYTFTNYGMNWVRQAPGQGLEWMG<br>WINTYTGETTYAEDFKGRFVFSLDTSVSTAYLQISSLKAEDTAVYYCEREGG<br>VNNWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKS*CD* |
| SEQ ID NO: 191 | C' terminal-modified AFD.v11 Heavy Chain | EVQLVQSGPELKKPGASVKVSCKASGYTFTNYGMNWVRQAPGQGLEWMG<br>WISTYTGETTYAEDFKGRFVFSLDTSVSTAYLQISSLKAEDTAVYYCEREGG<br>VNNWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKS*CD* |
| SEQ ID NO: 192 | C' terminal-modified AFD.v12 Heavy Chain | EVQLVQSGPELKKPGASVKVSCKASGYTFTNYGMNWVRQAPGQGLEWMG<br>WINTYTGETTYAEDFKGRFVFSLDTSVSTAYLQISSLKAEDTAVYYCEREGG<br>VDNWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKS*CD* |
| SEQ ID NO: 193 | C' terminal-modified AFD.v13 Heavy Chain | EVQLVQSGPELKKPGASVKVSCKASGYTFTNYGMNWVRQAPGQGLEWMG<br>WINTYTGETTYAEDFKGRFVFSLDTSVSTAYLQISSLKAEDTAVYYCEREGG<br>VQNWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKS*CD* |
| SEQ ID NO: 194 | C' terminal-modified AFD.v14 Heavy Chain | EVQLVQSGPELKKPGASVKVSCKASGYTFTNYGMNWVRQAPGQGLEWMG<br>WINTYTGETTYAEDFKGRFVFSLDTSVSTAYLQISSLKAEDTAVYYCEREGG<br>VSNWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKS*CD* |
| SEQ ID NO: 195 | C' terminal-modified AFD.v15 Heavy Chain | EVQLVQSGPELKKPGASVKVSCKASGYTFTNYGMNWVRQAPGQGLEWMG<br>WINTYTGETTYAEDFKGRFVFSLDTSVSTAYLQISSLKAEDTAVYYCEREGG<br>VSNWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKS*CD* |
| SEQ ID NO: 196 | C' terminal-modified huAFD.v2.0 Heavy Chain | EVQLVQSGAEVKKPGASVKVSCKASGYTFTSYYMYWVRQAPGQGLEWIGE<br>INPTSGGTNFNEKFKSRATLTVDTSTSTAYLELSSLRSEDTAVYYCAREGGFA<br>YVVGQGTLVTVSSASTKGPSVFPLAPSSKSTSGGTAALGCLVKDYFPEPVTVS<br>WNSGALTSGVHTFPAVLQSSGLYSLSSVVTVPSSSLGTQTYICNVNHKPSNT<br>KVDKKVEPKS*CD* |
| SEQ ID NO: 197 | C' terminal-modified huAFD.v2.1 Heavy | EVQLVQSGAEVKKPGASVKVSCKASGYTFTSYYMYWVRQAPGQGLEWIGE<br>INPTSGGTNFNEKFKSRATLTVDTSTSTAYLELSSLRSEDTAVYYCAREGGFA |

TABLE 8-continued

Heavy chain and light chain amino acid sequences of C' terminal-modified anti-Factor D antibodies

| | Chain | YVVGQGTLVTVSSASTKGPSVFPLAPSSKSTSGGTAALGCLVKDYFPEPVTVS<br>WNSGALTSGVHTFPPAVLQSSGLYSLSSVVTVPSSSLGTQTYICNVNHKPSNT<br>KVDKKVEPKS*CD* |
|---|---|---|
| SEQ ID<br>NO: 198 | C' terminal-modified<br>huAFD.v2.3 Heavy<br>Chain | EVQLVQSGAEVKKPGASVKVSCKASGYTFTSYYMYWVRQAPGQGLEWIGE<br>INPYSGDTNFNEKFKSRATLTVDTSTSTAYLELSSLRSEDTAVYYCAREGGFA<br>YVVGQGTLVTVSSASTKGPSVFPLAPSSKSTSGGTAALGCLVKDYFPEPVTVS<br>WNSGALTSGVHTFPAVLQSSGLYSLSSVVTVPSSSLGTQTYICNVNHKPSNT<br>KVDKKVEPKS*CD* |
| SEQ ID<br>NO: 199 | C' terminal-modified<br>huAFD.v1 Heavy<br>Chain | EVQLVQSGAEVKKPGASVKVSCKASGYTFTSYYMYWVRQAPGQGLEWIGE<br>INPTNGGTNFNEKFKSRATLTVDTSTSTAYLELSSLRSEDTAVYYCAREGGF<br>AYWGQGTLVTVSSASTKGPSVFPLAPSSKSTSGGTAALGCLVKDYFPEPVTV<br>SWNSGALTSGVHTFPAVLQSSGLYSLSSVVTVPSSSLGTQTYICNVNHKPSN<br>TKVDKKVEPKS*CD* |
| SEQ ID<br>NO: 200 | C' terminal-modified<br>huAFD.v1.1 Heavy<br>Chain | EVQLVQSGAEVKKPGASVKVSCKASGYTFTSYYMYWVRQAPGQGLEWIGE<br>INPTQGGTNFNEKFKSRATLTVDTSTSTAYLELSSLRSEDTAVYYCAREGGF<br>AYWGQGTLVTVSSASTKGPSVFPLAPSSKSTSGGTAALGCLVKDYFPEPVTV<br>SWNSGALTSGVHTFPAVLQSSGLYSLSSVVTVPSSSLGTQTYICNVNHKPSN<br>TKVDKKVEPKS*CD* |
| SEQ ID<br>NO: 201 | C' terminal-modified<br>huAFD.v2.2 Heavy<br>Chain | EVQLVQSGAEVKKPGASVKVSCKASGYTFTSYYMYWVRQAPGQGLEWIGE<br>INPTSGDTNFNEKFKSRATLTVDTSTSTAYLELSSLRSEDTAVYYCAREGGFA<br>YVVGQGTLVTVSSASTKGPSVFPLAPSSKSTSGGTAALGCLVKDYFPEPVTVS<br>WNSGALTSGVHTFPAVLQSSGLYSLSSVVTVPSSSLGTQTYICNVNHKPSNT<br>KVDKKVEPKS*CD* |
| SEQ ID<br>NO: 202 | C' terminal-modified<br>huAFD.v2.4 Heavy<br>Chain | EVQLVQSGAEVKKPGASVKVSCKASGYTFTSYYMYWVRQAPGQGLEWIGE<br>INPTSGETNFNEKFKSRATLTVDTSTSTAYLELSSLRSEDTAVYYCAREGGFA<br>YVVGQGTLVTVSSASTKGPSVFPLAPSSKSTSGGTAALGCLVKDYFPEPVTVS<br>WNSGALTSGVHTFPAVLQSSGLYSLSSVVTVPSSSLGTQTYICNVNHKPSNT<br>KVDKKVEPKS*CD* |
| SEQ ID<br>NO: 203 | C' terminal-modified<br>huAFD.v2.5 Heavy<br>Chain | EVQLVQSGAEVKKPGASVKVSCKASGYTFTSYYMYWVRQAPGQGLEWIGE<br>INPYSGGTNFNEKFKSRATLTVDTSTSTAYLELSSLRSEDTAVYYCAREGGFA<br>YVVGQGTLVTVSSASTKGPSVFPLAPSSKSTSGGTAALGCLVKDYFPEPVTVS<br>WNSGALTSGVHTFPAVLQSSGLYSLSSVVTVPSSSLGTQTYICNVNHKPSNT<br>KVDKKVEPKS*CD* |
| SEQ ID<br>NO: 204 | C' terminal-modified<br>huAFD.v2.6 Heavy<br>Chain | EVQLVQSGAEVKKPGASVKVSCKASGYTFTSYYMYWVRQAPGQGLEWIGE<br>INPTSGGTNFNEKFKSRATLTVDTSTSTAYLELSSLRSEDTAVYYCAREGGFA<br>YVVGQGTLVTVSSASTKGPSVFPLAPSSKSTSGGTAALGCLVKDYFPEPVTVS<br>WNSGALTSGVHTFPAVLQSSGLYSLSSVVTVPSSSLGTQTYICNVNHKPSNT<br>KVDKKVEPKS*CD* |
| SEQ ID<br>NO: 205 | C' terminal-modified<br>huAFD.v2.7 Heavy<br>Chain | EVQLVQSGAEVKKPGASVKVSCKASGYTFTSYYMYWVRQAPGQGLEWIGE<br>INPTSGGTNFNEKFKSRATLTVDTSTSTAYLELSSLRSEDTAVYYCAREGGFA<br>YVVGQGTLVTVSSASTKGPSVFPLAPSSKSTSGGTAALGCLVKDYFPEPVTVS<br>WNSGALTSGVHTFPAVLQSSGLYSLSSVVTVPSSSLGTQTYICNVNHKPSNT<br>KVDKKVEPKS*CD* |
| SEQ ID<br>NO: 206 | C' terminal-modified<br>huAFD.v2.8 Heavy<br>Chain | EVQLVQSGAEVKKPGASVKVSCKASGYTFTSYYMYWVRQAPGQGLEWIGE<br>INPTSGGTNFNEKFKSRATLTVDTSTSTAYLELSSLRSEDTAVYYCAREGGFA<br>YVVGQGTLVTVSSASTKGPSVFPLAPSSKSTSGGTAALGCLVKDYFPEPVTVS<br>WNSGALTSGVHTFPAVLQSSGLYSLSSVVTVPSSSLGTQTYICNVNHKPSNT<br>KVDKKVEPKS*CD* |
| SEQ ID<br>NO: 207 | C' terminal-modified<br>huAFD.v2.9 Heavy<br>Chain | EVQLVQSGAEVKKPGASVKVSCKASGYTFTSYYMYWVRQAPGQGLEWIG<br>WINPTSGGTNFNEKFKSRATLTVDTSTSTAYLELSSLRSEDTAVYYCAREGG<br>FAYWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKS*CD* |
| SEQ ID<br>NO: 208 | C' terminal-modified<br>huAFD.v2.10 Heavy<br>Chain | EVQLVQSGAEVKKPGASVKVSCKASGYTFTSYYMYWVRQAPGQGLEWIGE<br>INPTSGGTNFNEKFKSRATLTVDTSTSTAYLELSSLRSEDTAVYYCAREGGFA<br>YVVGQGTLVTVSSASTKGPSVFPLAPSSKSTSGGTAALGCLVKDYFPEPVTVS<br>WNSGALTSGVHTFPAVLQSSGLYSLSSVVTVPSSSLGTQTYICNVNHKPSNT<br>KVDKKVEPKS*CD* |
| SEQ ID<br>NO: 209 | C' terminal-modified<br>huAFD.v2.11 Heavy<br>Chain | EVQLVQSGAEVKKPGASVKVSCKASGYTFTSYYMYWVRQAPGQGLEWIGE<br>INPTSGGTNFNEKFKSRATLTVDTSTSTAYLELSSLRSEDTAVYYCAREGGFA<br>YVVGQGTLVTVSSASTKGPSVFPLAPSSKSTSGGTAALGCLVKDYFPEPVTVS<br>WNSGALTSGVHTFPAVLQSSGLYSLSSVVTVPSSSLGTQTYICNVNHKPSNT<br>KVDKKVEPKS*CD* |

TABLE 8-continued

Heavy chain and light chain amino acid sequences of C' terminal-modified anti-Factor D antibodies

| SEQ ID NO: 210 | C' terminal-modified huAFD.v2.12 Heavy Chain | EVQLVQSGAEVKKPGASVKVSCKASGYTFTSYYMYWVRQAPGQGLEWIGE INPYSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CD* |
| --- | --- | --- |
| SEQ ID NO: 211 | C' terminal-modified huAFD.v2.13 Heavy | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CD* |
| SEQ ID NO: 212 | C' terminal-modified huAFD.v2.14 Heavy Chain | EVQLVQSGAEVKKPGASVKVSCKASGYTFTSYYMYWVRQAPGQGLEWIGE INPTSGETNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CD* |
| SEQ ID NO: 213 | C' terminal-modified huAFD .v2 .15 Heavy Chain | EVQLVQSGAEVKKPGASVKVSCKASGYTFTSYYMYWVRQAPGQGLEWIGE INPYSGETNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CD* |
| SEQ ID NO: 214 | C' terminal-modified AFD WT Heavy Chain | EVQLVQSGPELKKPGASVKVSCKASGYTFTNYGMNWVRQAPGQGLEWMG WINTYTGETTYADDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDKTHL* |
| SEQ ID NO: 215 | C' terminal-modified AFD.v1 Heavy Chain | EVQLVQSGPELKKPGASVKVSCKASGYTFTNYGMNWVRQAPGQGLEWMG WINTYTGETTYADDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDKTHL* |
| SEQ ID NO: 216 | C' terminal-modified AFD.v2 Heavy Chain | EVQLVQSGPELKKPGASVKVSCKASGYTFTNYGMNWVRQAPGQGLEWMG WINTYTGETTYADDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDKTHL* |
| SEQ ID NO: 217 | C' terminal-modified AFD.v3 Heavy Chain | EVQLVQSGPELKKPGASVKVSCKASGYTFTNYGMNWVRQAPGQGLEWMG WINTYTGETTYADDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDKTHL* |
| SEQ ID NO: 218 | C' terminal-modified AFD.v4 Heavy Chain | EVQLVQSGPELKKPGASVKVSCKASGYTFTNYGMNWVRQAPGQGLEWMG WINTYTGETTYADDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDKTHL* |
| SEQ ID NO: 219 | C' terminal-modified AFD.v5 Heavy Chain | EVQLVQSGPELKKPGASVKVSCKASGYTFTNYGMNWVRQAPGQGLEWMG WINTYTGETTYADDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDKTHL* |
| SEQ ID NO: 220 | C' terminal-modified AFD.v6 Heavy Chain | EVQLVQSGPELKKPGASVKVSCKASGYTFTNYGMNWVRQAPGQGLEWMG WINTYTGETTYAEDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDKTHL* |
| SEQ ID NO: 221 | C' terminal-modified AFD.v7 Heavy Chain | EVQLVQSGPELKKPGASVKVSCKASGYTFTNYGMNWVRQAPGQGLEWMG WINTYTGETTYAEDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDKTHL* |
| SEQ ID NO: 222 | C' terminal-modified AFD.v8 Heavy Chain | EVQLVQSGPELKKPGASVKVSCKASGYTFTNYGMNWVRQAPGQGLEWMG WINTYTGETTYAEDFKGRFVFSLDTSVSTAYLQISSLKAEDTAVYYCEREGG |

TABLE 8-continued

Heavy chain and light chain amino acid sequences of C' terminal-modified anti-Factor D antibodies

| | | |
|---|---|---|
| | | VNNWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKS*CDKTHL* |
| SEQ ID<br>NO: 223 | C' terminal-modified<br>AFD.v9 Heavy Chain | EVQLVQSGPELKKPGASVKVSCKASGYTFTNYGMNWVRQAPGQGLEWMG<br>WINTYTGETTYAEDFKGRFVFSLDTSVSTAYLQISSLKAEDTAVYYCEREGG<br>VNNWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKS*CDKTHL* |
| SEQ ID<br>NO: 224 | C' terminal-modified<br>AFD.v10 Heavy Chain | EVQLVQSGPELKKPGASVKVSCKASGYTFTNYGMNWVRQAPGQGLEWMG<br>WINTYTGETTYAEDFKGRFVFSLDTSVSTAYLQISSLKAEDTAVYYCEREGG<br>VNNWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKS*CDKTHL* |
| SEQ ID<br>NO: 225 | C' terminal-modified<br>AFD.v11 Heavy Chain | EVQLVQSGPELKKPGASVKVSCKASGYTFTNYGMNWVRQAPGQGLEWMG<br>WISTYTGETTYAEDFKGRFVFSLDTSVSTAYLQISSLKAEDTAVYYCEREGG<br>VNNWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKS*CDKTHL* |
| SEQ ID<br>NO: 226 | C' terminal-modified<br>AFD.v12 Heavy Chain | EVQLVQSGPELKKPGASVKVSCKASGYTFTNYGMNWVRQAPGQGLEWMG<br>WINTYTGETTYAEDFKGRFVFSLDTSVSTAYLQISSLKAEDTAVYYCEREGG<br>VDNWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKS*CDKTHL* |
| SEQ ID<br>NO: 227 | C' terminal-modified<br>AFD.v13 Heavy Chain | EVQLVQSGPELKKPGASVKVSCKASGYTFTNYGMNWVRQAPGQGLEWMG<br>WINTYTGETTYAEDFKGRFVFSLDTSVSTAYLQISSLKAEDTAVYYCEREGG<br>VQNWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKS*CDKTHL* |
| SEQ ID<br>NO: 228 | C' terminal-modified<br>AFD.v14 Heavy Chain | EVQLVQSGPELKKPGASVKVSCKASGYTFTNYGMNWVRQAPGQGLEWMG<br>WINTYTGETTYAEDFKGRFVFSLDTSVSTAYLQISSLKAEDTAVYYCEREGG<br>VSNWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKS*CDKTHL* |
| SEQ ID<br>NO: 229 | C' terminal-modified<br>AFD.v15 Heavy Chain | EVQLVQSGPELKKPGASVKVSCKASGYTFTNYGMNWVRQAPGQGLEWMG<br>WINTYTGETTYAEDFKGRFVFSLDTSVSTAYLQISSLKAEDTAVYYCEREGG<br>VSNWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKS*CDKTHL* |
| SEQ ID<br>NO: 230 | C' terminal-modified<br>huAFD.v2.0 Heavy<br>Chain | EVQLVQSGAEVKKPGASVKVSCKASGYTFTSYYMYWVRQAPGQGLEWIGE<br>INPTSGGTNFNEKFKSRATLTVDTSTSTAYLELSSLRSEDTAVYYCAREGGFA<br>YVVGQGTLVTVSSASTKGPSVFPLAPSSKSTSGGTAALGCLVKDYFPEPVTVS<br>WNSGALTSGVHTFPAVLQSSGLYSLSSVVTVPSSSLGTQTYICNVNHKPSNT<br>KVDKKVEPKS*CDKTHL* |
| SEQ ID<br>NO: 231 | C' terminal-modified<br>huAFD.v2.1 Heavy<br>Chain | EVQLVQSGAEVKKPGASVKVSCKASGYTFTSYYMYWVRQAPGQGLEWIGE<br>INPTSGGTNFNEKFKSRATLTVDTSTSTAYLELSSLRSEDTAVYYCAREGGFA<br>YVVGQGTLVTVSSASTKGPSVFPLAPSSKSTSGGTAALGCLVKDYFPEPVTVS<br>WNSGALTSGVHTFPAVLQSSGLYSLSSVVTVPSSSLGTQTYICNVNHKPSNT<br>KVDKKVEPKS*CDKTHL* |
| SEQ ID<br>NO: 232 | C' terminal-modified<br>huAFD.v2.3 Heavy<br>Chain | EVQLVQSGAEVKKPGASVKVSCKASGYTFTSYYMYWVRQAPGQGLEWIGE<br>INPYSGDTNFNEKFKSRATLTVDTSTSTAYLELSSLRSEDTAVYYCAREGGFA<br>YVVGQGTLVTVSSASTKGPSVFPLAPSSKSTSGGTAALGCLVKDYFPEPVTVS<br>WNSGALTSGVHTFPAVLQSSGLYSLSSVVTVPSSSLGTQTYICNVNHKPSNT<br>KVDKKVEPKS*CDKTHL* |
| SEQ ID<br>NO: 233 | C' terminal-modified<br>huAFD.v1 Heavy<br>Chain | EVQLVQSGAEVKKPGASVKVSCKASGYTFTSYYMYWVRQAPGQGLEWIGE<br>INPTNGGTNFNEKFKSRATLTVDTSTSTAYLELSSLRSEDTAVYYCAREGGF<br>AYWGQGTLVTVSSASTKGPSVFPLAPSSKSTSGGTAALGCLVKDYFPEPVTV<br>SWNSGALTSGVHTFPAVLQSSGLYSLSSVVTVPSSSLGTQTYICNVNHKPSN<br>TKVDKKVEPKS*CDKTHL* |
| SEQ ID<br>NO: 234 | C' terminal-modified<br>huAFD.v1.1 Heavy<br>Chain | EVQLVQSGAEVKKPGASVKVSCKASGYTFTSYYMYWVRQAPGQGLEWIGE<br>INPTQGGTNFNEKFKSRATLTVDTSTSTAYLELSSLRSEDTAVYYCAREGGF<br>AYWGQGTLVTVSSASTKGPSVFPLAPSSKSTSGGTAALGCLVKDYFPEPVTV<br>SWNSGALTSGVHTFPAVLQSSGLYSLSSVVTVPSSSLGTQTYICNVNHKPSN<br>TKVDKKVEPKS*CDKTHL* |

TABLE 8-continued

Heavy chain and light chain amino acid sequences of C' terminal-modified anti-Factor D antibodies

| SEQ ID NO: 235 | C' terminal-modified huAFD.v2.2 Heavy Chain | EVQLVQSGAEVKKPGASVKVSCKASGYTFTSYYMYWVRQAPGQGLEWIGE INPTSGDTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDKTHL* |
| --- | --- | --- |
| SEQ ID NO: 236 | C' terminal-modified huAFD.v2.4 Heavy Chain | EVQLVQSGAEVKKPGASVKVSCKASGYTFTSYYMYWVRQAPGQGLEWIGE INPTSGETNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDKTHL* |
| SEQ ID NO: 237 | C' terminal-modified huAFD.v2.5 Heavy Chain | EVQLVQSGAEVKKPGASVKVSCKASGYTFTSYYMYWVRQAPGQGLEWIGE INPYSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDKTHL* |
| SEQ ID NO: 238 | C' terminal-modified huAFD.v2.6 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDKTHL* |
| SEQ ID NO: 239 | C' terminal-modified huAFD.v2.7 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDKTHL* |
| SEQ ID NO: 240 | C' terminal-modified huAFD.v2.8 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDKTHL* |
| SEQ ID NO: 241 | C' terminal-modified huAFD.v2.9 Heavy Chain | EVQLVQSGAEVKKPGASVKVSCKASGYTFTSYYMYWVRQAPGQGLEWIG WINPTSGGTNFNEKFKSRATLTVDTSTSTAYLELSSLRSEDTAVYYCAREGG FAYWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDKTHL* |
| SEQ ID NO: 242 | C' terminal-modified huAFD.v2.10 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDKTHL* |
| SEQ ID NO: 243 | C' terminal-modified huAFD.v2.11 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDKTHL* |
| SEQ ID NO: 244 | C' terminal-modified huAFD.v2.12 Heavy Chain | EVQLVQSGAEVKKPGASVKVSCKASGYTFTSYYMYWVRQAPGQGLEWIGE INPYSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDKTHL* |
| SEQ ID NO: 245 | C' terminal-modified huAFD.v2.13 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDKTHL* |
| SEQ ID NO: 246 | C' terminal-modified huAFD.v2.14 Heavy Chain | EVQLVQSGAEVKKPGASVKVSCKASGYTFTSYYMYWVRQAPGQGLEWIGE INPTSGETNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDKTHL* |

TABLE 8-continued

Heavy chain and light chain amino acid sequences of C' terminal-modified anti-Factor D antibodies

| SEQ ID NO: 247 | C' terminal-modified huAFD.v2.15 Heavy Chain | EVQLVQSGAEVKKPGASVKVSCKASGYTFTSYYMYWVRQAPGQGLEWIGE INPYSGETNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDKTHL* |
|---|---|---|
| SEQ ID NO: 248 | C' terminal-modified AFD WT Heavy Chain | EVQLVQSGPELKKPGASVKVSCKASGYTFTNYGMNWVRQAPGQGLEWMG WINTYTGETTYADDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDK* |
| SEQ ID NO: 249 | C' terminal-modified AFD.v1 Heavy Chain | EVQLVQSGPELKKPGASVKVSCKASGYTFTNYGMNWVRQAPGQGLEWMG WINTYTGETTYADDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDK* |
| SEQ ID NO: 250 | C' terminal-modified AFD.v2 Heavy Chain | EVQLVQSGPELKKPGASVKVSCKASGYTFTNYGMNWVRQAPGQGLEWMG WINTYTGETTYADDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDK* |
| SEQ ID NO: 251 | C' terminal-modified AFD.v3 Heavy Chain | EVQLVQSGPELKKPGASVKVSCKASGYTFTNYGMNWVRQAPGQGLEWMG WINTYTGETTYADDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDK* |
| SEQ ID NO: 252 | C' terminal-modified AFD.v4 Heavy Chain | EVQLVQSGPELKKPGASVKVSCKASGYTFTNYGMNWVRQAPGQGLEWMG WINTYTGETTYADDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDK* |
| SEQ ID NO: 253 | C' terminal-modified AFD.v5 Heavy Chain | EVQLVQSGPELKKPGASVKVSCKASGYTFTNYGMNWVRQAPGQGLEWMG WINTYTGETTYADDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDK* |
| SEQ ID NO: 254 | C' terminal-modified AFD.v6 Heavy Chain | EVQLVQSGPELKKPGASVKVSCKASGYTFTNYGMNWVRQAPGQGLEWMG WINTYTGETTYAEDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDK* |
| SEQ ID NO: 255 | C' terminal-modified AFD.v7 Heavy Chain | EVQLVQSGPELKKPGASVKVSCKASGYTFTNYGMNWVRQAPGQGLEWMG WINTYTGETTYAEDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDK* |
| SEQ ID NO: 256 | C' terminal-modified AFD.v8 Heavy Chain | EVQLVQSGPELKKPGASVKVSCKASGYTFTNYGMNWVRQAPGQGLEWMG WINTYTGETTYAEDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDK* |
| SEQ ID NO: 257 | C' terminal-modified AFD.v9 Heavy Chain | EVQLVQSGPELKKPGASVKVSCKASGYTFTNYGMNWVRQAPGQGLEWMG WINTYTGETTYAEDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDK* |
| SEQ ID NO: 258 | C' terminal-modified AFD.v10 Heavy Chain | EVQLVQSGPELKKPGASVKVSCKASGYTFTNYGMNWVRQAPGQGLEWMG WINTYTGETTYAEDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDK* |
| SEQ ID NO: 259 | C' terminal-modified AFD.v11 Heavy Chain | EVQLVQSGPELKKPGASVKVSCKASGYTFTNYGMNWVRQAPGQGLEWMG WISTYTGETTYAEDFKGRFVFSLDTSVSTAYLQISSLKAEDTAVYYCEREGG |

TABLE 8-continued

Heavy chain and light chain amino acid sequences of C' terminal-modified anti-Factor D antibodies

| | | |
|---|---|---|
| | | VNNWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKS*CDK* |
| SEQ ID<br>NO: 260 | C' terminal-modified<br>AFD.v12 Heavy Chain | EVQLVQSGPELKKPGASVKVSCKASGYTFTNYGMNWVRQAPGQGLEWMG<br>WINTYTGETTYAEDFKGRFVFSLDTSVSTAYLQISSLKAEDTAVYYCEREGG<br>VDNWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKS*CDK* |
| SEQ ID<br>NO: 261 | C' terminal-modified<br>AFD.v13 Heavy Chain | EVQLVQSGPELKKPGASVKVSCKASGYTFTNYGMNWVRQAPGQGLEWMG<br>WINTYTGETTYAEDFKGRFVFSLDTSVSTAYLQISSLKAEDTAVYYCEREGG<br>VQNWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKS*CDK* |
| SEQ ID<br>NO: 262 | C' terminal-modified<br>AFD.v14 Heavy Chain | EVQLVQSGPELKKPGASVKVSCKASGYTFTNYGMNWVRQAPGQGLEWMG<br>WINTYTGETTYAEDFKGRFVFSLDTSVSTAYLQISSLKAEDTAVYYCEREGG<br>VSNWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKS*CDK* |
| SEQ ID<br>NO: 263 | C' terminal-modified<br>AFD.v15 Heavy Chain | EVQLVQSGPELKKPGASVKVSCKASGYTFTNYGMNWVRQAPGQGLEWMG<br>WINTYTGETTYAEDFKGRFVFSLDTSVSTAYLQISSLKAEDTAVYYCEREGG<br>VSNWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKS*CDK* |
| SEQ ID<br>NO: 264 | C' terminal-modified<br>huAFD.v2.0 Heavy<br>Chain | EVQLVQSGAEVKKPGASVKVSCKASGYTFTSYYMYWVRQAPGQGLEWIGE<br>INPTSGGTNFNEKFKSRATLTVDTSTSTAYLELSSLRSEDTAVYYCAREGGFA<br>YVVGQGTLVTVSSASTKGPSVFPLAPSSKSTSGGTAALGCLVKDYFPEPVTVS<br>WNSGALTSGVHTFPAVLQSSGLYSLSSVVTVPSSSLGTQTYICNVNHKPSNT<br>KVDKKVEPKS*CDK* |
| SEQ ID<br>NO: 265 | C' terminal-modified<br>huAFD.v2.1 Heavy<br>Chain | EVQLVQSGAEVKKPGASVKVSCKASGYTFTSYYMYWVRQAPGQGLEWIGE<br>INPTSGGTNFNEKFKSRATLTVDTSTSTAYLELSSLRSEDTAVYYCAREGGFA<br>YVVGQGTLVTVSSASTKGPSVFPLAPSSKSTSGGTAALGCLVKDYFPEPVTVS<br>WNSGALTSGVHTFPAVLQSSGLYSLSSVVTVPSSSLGTQTYICNVNHKPSNT<br>KVDKKVEPKS*CDK* |
| SEQ ID<br>NO: 266 | C' terminal-modified<br>huAFD.v2.3 Heavy<br>Chain | EVQLVQSGAEVKKPGASVKVSCKASGYTFTSYYMYWVRQAPGQGLEWIGE<br>INPYSGDTNFNEKFKSRATLTVDTSTSTAYLELSSLRSEDTAVYYCAREGGFA<br>YVVGQGTLVTVSSASTKGPSVFPLAPSSKSTSGGTAALGCLVKDYFPEPVTVS<br>WNSGALTSGVHTFPAVLQSSGLYSLSSVVTVPSSSLGTQTYICNVNHKPSNT<br>KVDKKVEPKS*CDK* |
| SEQ ID<br>NO: 267 | C' terminal-modified<br>huAFD.v1 Heavy<br>Chain | EVQLVQSGAEVKKPGASVKVSCKASGYTFTSYYMYWVRQAPGQGLEWIGE<br>INPTNGGTNFNEKFKSRATLTVDTSTSTAYLELSSLRSEDTAVYYCAREGGF<br>AYWGQGTLVTVSSASTKGPSVFPLAPSSKSTSGGTAALGCLVKDYFPEPVTV<br>SWNSGALTSGVHTFPAVLQSSGLYSLSSVVTVPSSSLGTQTYICNVNHKPSN<br>TKVDKKVEPKS*CDK* |
| SEQ ID<br>NO: 268 | C' terminal-modified<br>huAFD.v1.1 Heavy<br>Chain | EVQLVQSGAEVKKPGASVKVSCKASGYTFTSYYMYWVRQAPGQGLEWIGE<br>INPTQGGTNFNEKFKSRATLTVDTSTSTAYLELSSLRSEDTAVYYCAREGGF<br>AYWGQGTLVTVSSASTKGPSVFPLAPSSKSTSGGTAALGCLVKDYFPEPVTV<br>SWNSGALTSGVHTFPAVLQSSGLYSLSSVVTVPSSSLGTQTYICNVNHKPSN<br>TKVDKKVEPKS*CDK* |
| SEQ ID<br>NO: 269 | C' terminal-modified<br>huAFD.v2.2 Heavy<br>Chain | EVQLVQSGAEVKKPGASVKVSCKASGYTFTSYYMYWVRQAPGQGLEWIGE<br>INPTSGDTNFNEKFKSRATLTVDTSTSTAYLELSSLRSEDTAVYYCAREGGFA<br>YVVGQGTLVTVSSASTKGPSVFPLAPSSKSTSGGTAALGCLVKDYFPEPVTVS<br>WNSGALTSGVHTFPAVLQSSGLYSLSSVVTVPSSSLGTQTYICNVNHKPSNT<br>KVDKKVEPKS*CDK* |
| SEQ ID<br>NO: 270 | C' terminal-modified<br>huAFD.v2.4 Heavy<br>Chain | EVQLVQSGAEVKKPGASVKVSCKASGYTFTSYYMYWVRQAPGQGLEWIGE<br>INPTSGETNFNEKFKSRATLTVDTSTSTAYLELSSLRSEDTAVYYCAREGGFA<br>YVVGQGTLVTVSSASTKGPSVFPLAPSSKSTSGGTAALGCLVKDYFPEPVTVS<br>WNSGALTSGVHTFPAVLQSSGLYSLSSVVTVPSSSLGTQTYICNVNHKPSNT<br>KVDKKVEPKS*CDK* |
| SEQ ID<br>NO: 271 | C' terminal-modified<br>huAFD.v2.5 Heavy<br>Chain | EVQLVQSGAEVKKPGASVKVSCKASGYTFTSYYMYWVRQAPGQGLEWIGE<br>INPYSGGTNFNEKFKSRATLTVDTSTSTAYLELSSLRSEDTAVYYCAREGGFA<br>YVVGQGTLVTVSSASTKGPSVFPLAPSSKSTSGGTAALGCLVKDYFPEPVTVS<br>WNSGALTSGVHTFPAVLQSSGLYSLSSVVTVPSSSLGTQTYICNVNHKPSNT<br>KVDKKVEPKS*CDK* |

TABLE 8-continued

Heavy chain and light chain amino acid sequences of C' terminal-modified anti-Factor D antibodies

| SEQ ID NO: 272 | C' terminal-modified huAFD.v2.6 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDK* |
|---|---|---|
| SEQ ID NO: 273 | C' terminal-modified huAFD.v2.7 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDK* |
| SEQ ID NO: 274 | C' terminal-modified huAFD.v2.8 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDK* |
| SEQ ID NO: 275 | C' terminal-modified huAFD.v2.9 Heavy Chain | EVQLVQSGAEVKKPGASVKVSCKASGYTFTSYYMYWVRQAPGQGLEWIG WINPTSGGTNFNEKFKSRATLTVDTSTSTAYLELSSLRSEDTAVYYCAREGG FAYWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDK* |
| SEQ ID NO: 276 | C' terminal-modified huAFD.v2.10 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDK* |
| SEQ ID NO: 277 | C' terminal-modified huAFD.v2.11 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDK* |
| SEQ ID NO: 278 | C' terminal-modified huAFD.v2.12 Heavy Chain | EVQLVQSGAEVKKPGASVKVSCKASGYTFTSYYMYWVRQAPGQGLEWIGE INPYSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDK* |
| SEQ ID NO: 279 | C' terminal-modified huAFD.v2.13 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDK* |
| SEQ ID NO: 280 | C' terminal-modified huAFD.v2.14 Heavy Chain | EVQLVQSGAEVKKPGASVKVSCKASGYTFTSYYMYWVRQAPGQGLEWIGE INPTSGETNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDK* |
| SEQ ID NO: 281 | C' terminal-modified huAFD.v2.15 Heavy Chain | EVQLVQSGAEVKKPGASVKVSCKASGYTFTSYYMYWVRQAPGQGLEWIGE INPYSGETNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDK* |
| SEQ ID NO: 282 | C' terminal-modified AFD WT Heavy Chain | EVQLVQSGPELKKPGASVKVSCKASGYTFTNYGMNWVRQAPGQGLEWMG WINTYTGETTYADDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDKT* |
| SEQ ID NO: 283 | C' terminal-modified AFD.v1 Heavy Chain | EVQLVQSGPELKKPGASVKVSCKASGYTFTNYGMNWVRQAPGQGLEWMG WINTYTGETTYADDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDKT* |
| SEQ ID NO: 284 | C' terminal-modified AFD.v2 Heavy Chain | EVQLVQSGPELKKPGASVKVSCKASGYTFTNYGMNWVRQAPGQGLEWMG WINTYTGETTYADDFKGRFVFSLDTSVSTAYLQISSLKAEDTAVYYCEREGG |

TABLE 8-continued

Heavy chain and light chain amino acid sequences of C' terminal-modified anti-Factor D antibodies

| | | |
|---|---|---|
| | | VNNWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKS*CDKT* |
| SEQ ID<br>NO: 285 | C' terminal-modified<br>AFD.v3 Heavy Chain | EVQLVQSGPELKKPGASVKVSCKASGYTFTNYGMNWVRQAPGQGLEWMG<br>WINTYTGETTYADDFKGRFVFSLDTSVSTAYLQISSLKAEDTAVYYCEREGG<br>VNNWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKS*CDKT* |
| SEQ ID<br>NO: 286 | C' terminal-modified<br>AFD.v4 Heavy Chain | EVQLVQSGPELKKPGASVKVSCKASGYTFTNYGMNWVRQAPGQGLEWMG<br>WINTYTGETTYADDFKGRFVFSLDTSVSTAYLQISSLKAEDTAVYYCEREGG<br>VNNWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKS*CDKT* |
| SEQ ID<br>NO: 287 | C' terminal-modified<br>AFD.v5 Heavy Chain | EVQLVQSGPELKKPGASVKVSCKASGYTFTNYGMNWVRQAPGQGLEWMG<br>WINTYTGETTYADDFKGRFVFSLDTSVSTAYLQISSLKAEDTAVYYCEREGG<br>VNNWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKS*CDKT* |
| SEQ ID<br>NO: 288 | C' terminal-modified<br>AFD.v6 Heavy Chain | EVQLVQSGPELKKPGASVKVSCKASGYTFTNYGMNWVRQAPGQGLEWMG<br>WINTYTGETTYAEDFKGRFVFSLDTSVSTAYLQISSLKAEDTAVYYCEREGG<br>VNNWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKS*CDKT* |
| SEQ ID<br>NO: 289 | C' terminal-modified<br>AFD.v7 Heavy Chain | EVQLVQSGPELKKPGASVKVSCKASGYTFTNYGMNWVRQAPGQGLEWMG<br>WINTYTGETTYAEDFKGRFVFSLDTSVSTAYLQISSLKAEDTAVYYCEREGG<br>VNNWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKS*CDKT* |
| SEQ ID<br>NO: 290 | C' terminal-modified<br>AFD.v8 Heavy Chain | EVQLVQSGPELKKPGASVKVSCKASGYTFTNYGMNWVRQAPGQGLEWMG<br>WINTYTGETTYAEDFKGRFVFSLDTSVSTAYLQISSLKAEDTAVYYCEREGG<br>VNNWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKS*CDKT* |
| SEQ ID<br>NO: 291 | C' terminal-modified<br>AFD.v9 Heavy Chain | EVQLVQSGPELKKPGASVKVSCKASGYTFTNYGMNWVRQAPGQGLEWMG<br>WINTYTGETTYAEDFKGRFVFSLDTSVSTAYLQISSLKAEDTAVYYCEREGG<br>VNNWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKS*CDKT* |
| SEQ ID<br>NO: 292 | C' terminal-modified<br>AFD.v10 Heavy Chain | EVQLVQSGPELKKPGASVKVSCKASGYTFTNYGMNWVRQAPGQGLEWMG<br>WINTYTGETTYAEDFKGRFVFSLDTSVSTAYLQISSLKAEDTAVYYCEREGG<br>VNNWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKS*CDKT* |
| SEQ ID<br>NO: 293 | C' terminal-modified<br>AFD.v11 Heavy Chain | EVQLVQSGPELKKPGASVKVSCKASGYTFTNYGMNWVRQAPGQGLEWMG<br>WISTYTGETTYAEDFKGRFVFSLDTSVSTAYLQISSLKAEDTAVYYCEREGG<br>VNNWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKS*CDKT* |
| SEQ ID<br>NO: 294 | C' terminal-modified<br>AFD.v12 Heavy Chain | EVQLVQSGPELKKPGASVKVSCKASGYTFTNYGMNWVRQAPGQGLEWMG<br>WINTYTGETTYAEDFKGRFVFSLDTSVSTAYLQISSLKAEDTAVYYCEREGG<br>VDNWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKS*CDKT* |
| SEQ ID<br>NO: 295 | C' terminal-modified<br>AFD.v13 Heavy Chain | EVQLVQSGPELKKPGASVKVSCKASGYTFTNYGMNWVRQAPGQGLEWMG<br>WINTYTGETTYAEDFKGRFVFSLDTSVSTAYLQISSLKAEDTAVYYCEREGG<br>VQNWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKS*CDKT* |
| SEQ ID<br>NO: 296 | C' terminal-modified<br>AFD.v14 Heavy Chain | EVQLVQSGPELKKPGASVKVSCKASGYTFTNYGMNWVRQAPGQGLEWMG<br>WINTYTGETTYAEDFKGRFVFSLDTSVSTAYLQISSLKAEDTAVYYCEREGG<br>VSNWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKS*CDKT* |

TABLE 8-continued

Heavy chain and light chain amino acid sequences of C' terminal-modified anti-Factor D antibodies

| SEQ ID NO: 297 | C' terminal-modified AFD.v15 Heavy Chain | EVQLVQSGPELKKPGASVKVSCKASGYTFTNYGMNWVRQAPGQGLEWMG WINTYTGETTYAEDFKGRFVFSLDTSVSTAYLQISSLKAEDTAVYYCEREGG VSNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDKT* |
|---|---|---|
| SEQ ID NO: 298 | C' terminal-modified huAFD.v2.0 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDKT* |
| SEQ ID NO: 299 | C' terminal-modified huAFD.v2.1 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDKT* |
| SEQ ID NO: 300 | C' terminal-modified huAFD.v2.3 Heavy Chain | EVQLVQSGAEVKKPGASVKVSCKASGYTFTSYYMYWVRQAPGQGLEWIGE INPYSGDTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDKT* |
| SEQ ID NO: 301 | C' terminal-modified huAFD.v 1 Heavy Chain | EVQLVQSGAEVKKPGASVKVSCKASGYTFTSYYMYWVRQAPGQGLEWIGE INPTNGGTNFNEKFKSRATLTVDTSTSTAYLELSSLRSEDTAVYYCAREGGF AYWGQGTLVTVSSASTKGPSVFPLAPSSKSTSGGTAALGCLVKDYFPEPVTV SWNSGALTSGVHTFPAVLQSSGLYSLSSVVTVPSSSLGTQTYICNVNHKPSN TKVDKKVEPKS*CDKT* |
| SEQ ID NO: 302 | C' terminal-modified huAFD.v 1.1 Heavy Chain | EVQLVQSGAEVKKPGASVKVSCKASGYTFTSYYMYWVRQAPGQGLEWIGE INPTQGGTNFNEKFKSRATLTVDTSTSTAYLELSSLRSEDTAVYYCAREGGF AYWGQGTLVTVSSASTKGPSVFPLAPSSKSTSGGTAALGCLVKDYFPEPVTV SWNSGALTSGVHTFPAVLQSSGLYSLSSVVTVPSSSLGTQTYICNVNHKPSN TKVDKKVEPKS*CDKT* |
| SEQ ID NO: 303 | C' terminal-modified huAFD.v2.2 Heavy Chain | EVQLVQSGAEVKKPGASVKVSCKASGYTFTSYYMYWVRQAPGQGLEWIGE INPSGDTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDKT* |
| SEQ ID NO: 304 | C' terminal-modified huAFD.v2.4 Heavy Chain | EVQLVQSGAEVKKPGASVKVSCKASGYTFTSYYMYWVRQAPGQGLEWIGE INPSGETNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDKT* |
| SEQ ID NO: 305 | C' terminal-modified huAFD.v2.5 Heavy Chain | EVQLVQSGAEVKKPGASVKVSCKASGYTFTSYYMYWVRQAPGQGLEWIGE INPYSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDKT* |
| SEQ ID NO: 306 | C' terminal-modified huAFD.v2.6 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDKT* |
| SEQ ID NO: 307 | C' terminal-modified huAFD.v2.7 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDKT* |
| SEQ ID NO: 308 | C' terminal-modified huAFD.v2.8 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDKT* |
| SEQ ID NO: 309 | C' terminal-modified huAFD.v2.9 Heavy | EVQLVQSGAEVKKPGASVKVSCKASGYTFTSYYMYWVRQAPGQGLEWIG WINPTSGGTNFNEKFKSRATLTVDTSTSTAYLELSSLRSEDTAVYYCAREGG |

TABLE 8-continued

Heavy chain and light chain amino acid sequences of C' terminal-modified anti-Factor D antibodies

| | | |
|---|---|---|
| | Chain | FAYWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDKT* |
| SEQ ID NO: 310 | C' terminal-modified huAFD.v2.10 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDKT* |
| SEQ ID NO: 311 | C' terminal-modified huAFD.v2.11 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDKT* |
| SEQ ID NO: 312 | C' terminal-modified huAFD.v2.12 Heavy Chain | EVQLVQSGAEVKKPGASVKVSCKASGYTFTSYYMYWVRQAPGQGLEWIGE INPYSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDKT* |
| SEQ ID NO: 313 | C' terminal-modified huAFD.v2.13 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDKT* |
| SEQ ID NO: 314 | C' terminal-modified huAFD.v2.14 Heavy Chain | EVQLVQSGAEVKKPGASVKVSCKASGYTFTSYYMYWVRQAPGQGLEWIGE INPTSGETNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDKT* |
| SEQ ID NO: 315 | C' terminal-modified huAFD.v2.15 Heavy Chain | EVQLVQSGAEVKKPGASVKVSCKASGYTFTSYYMYWVRQAPGQGLEWIGE INPYSGETNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDKT* |
| SEQ ID NO: 316 | C' terminal-modified AFD WT Heavy Chain | EVQLVQSGPELKKPGASVKVSCKASGYTFTNYGMNWVRQAPGQGLEWMG WINTYTGETTYADDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDKTH* |
| SEQ ID NO: 317 | C' terminal-modified AFD.v1 Heavy Chain | EVQLVQSGPELKKPGASVKVSCKASGYTFTNYGMNWVRQAPGQGLEWMG WINTYTGETTYADDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDKTH* |
| SEQ ID NO: 318 | C' terminal-modified AFD.v2 Heavy Chain | EVQLVQSGPELKKPGASVKVSCKASGYTFTNYGMNWVRQAPGQGLEWMG WINTYTGETTYADDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDKTH* |
| SEQ ID NO: 319 | C' terminal-modified AFD.v3 Heavy Chain | EVQLVQSGPELKKPGASVKVSCKASGYTFTNYGMNWVRQAPGQGLEWMG WINTYTGETTYADDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDKTH* |
| SEQ ID NO: 320 | C' terminal-modified AFD.v4 Heavy Chain | EVQLVQSGPELKKPGASVKVSCKASGYTFTNYGMNWVRQAPGQGLEWMG WINTYTGETTYADDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDKTH* |
| SEQ ID NO: 321 | C' terminal-modified AFD.v5 Heavy Chain | EVQLVQSGPELKKPGASVKVSCKASGYTFTNYGMNWVRQAPGQGLEWMG WINTYTGETTYADDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDKTH* |

TABLE 8-continued

Heavy chain and light chain amino acid sequences of C' terminal-modified anti-Factor D antibodies

| SEQ ID NO: 322 | C' terminal-modified AFD.v6 Heavy Chain | EVQLVQSGPELKKPGASVKVSCKASGYTFTNYGMNWVRQAPGQGLEWMG WINTYTGETTYAEDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDKTH* |
| --- | --- | --- |
| SEQ ID NO: 323 | C' terminal-modified AFD.v7 Heavy Chain | EVQLVQSGPELKKPGASVKVSCKASGYTFTNYGMNWVRQAPGQGLEWMG WINTYTGETTYAEDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDKTH* |
| SEQ ID NO: 324 | C' terminal-modified AFD.v8 Heavy Chain | EVQLVQSGPELKKPGASVKVSCKASGYTFTNYGMNWVRQAPGQGLEWMG WINTYTGETTYAEDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDKTH* |
| SEQ ID NO: 325 | C' terminal-modified AFD.v9 Heavy Chain | EVQLVQSGPELKKPGASVKVSCKASGYTFTNYGMNWVRQAPGQGLEWMG WINTYTGETTYAEDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDKTH* |
| SEQ ID NO: 326 | C' terminal-modified AFD.v10 Heavy Chain | EVQLVQSGPELKKPGASVKVSCKASGYTFTNYGMNWVRQAPGQGLEWMG WINTYTGETTYAEDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDKTH* |
| SEQ ID NO: 327 | C' terminal-modified AFD.v11 Heavy Chain | EVQLVQSGPELKKPGASVKVSCKASGYTFTNYGMNWVRQAPGQGLEWMG WISTYTGETTYAEDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDKTH* |
| SEQ ID NO: 328 | C' terminal-modified AFD.v12 Heavy Chain | EVQLVQSGPELKKPGASVKVSCKASGYTFTNYGMNWVRQAPGQGLEWMG WINTYTGETTYAEDFKGRFVFSLDTSVSTAYLQISSLKAEDTAVYYCEREGG VDNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDKTH* |
| SEQ ID NO: 329 | C' terminal-modified AFD.v13 Heavy Chain | EVQLVQSGPELKKPGASVKVSCKASGYTFTNYGMNWVRQAPGQGLEWMG WINTYTGETTYAEDFKGRFVFSLDTSVSTAYLQISSLKAEDTAVYYCEREGG VQNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDKTH* |
| SEQ ID NO: 330 | C' terminal-modified AFD.v14 Heavy Chain | EVQLVQSGPELKKPGASVKVSCKASGYTFTNYGMNWVRQAPGQGLEWMG WINTYTGETTYAEDFKGRFVFSLDTSVSTAYLQISSLKAEDTAVYYCEREGG VSNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDKTH* |
| SEQ ID NO: 331 | C' terminal-modified AFD.v15 Heavy Chain | EVQLVQSGPELKKPGASVKVSCKASGYTFTNYGMNWVRQAPGQGLEWMG WINTYTGETTYAEDFKGRFVFSLDTSVSTAYLQISSLKAEDTAVYYCEREGG VSNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDKTH* |
| SEQ ID NO: 332 | C' terminal-modified huAFD.v2.0 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDKTH* |
| SEQ ID NO: 333 | C' terminal-modified huAFD.v2.1 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDKTH* |

TABLE 8-continued

Heavy chain and light chain amino acid sequences of C' terminal-modified anti-Factor D antibodies

| SEQ ID NO: 334 | C' terminal-modified huAFD.v2.3 Heavy Chain | EVQLVQSGAEVKKPGASVKVSCKASGYTFTSYYMYWVRQAPGQGLEWIGE INPYSGDTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDKTH* |
| --- | --- | --- |
| SEQ ID NO: 335 | C' terminal-modified huAFD.v1 Heavy Chain | EVQLVQSGAEVKKPGASVKVSCKASGYTFTSYYMYWVRQAPGQGLEWIGE INPTNGGTNFNEKFKSRATLTVDTSTSTAYLELSSLRSEDTAVYYCAREGGF AYWGQGTLVTVSSASTKGPSVFPLAPSSKSTSGGTAALGCLVKDYFPEPVTV SWNSGALTSGVHTFPAVLQSSGLYSLSSVVTVPSSSLGTQTYICNVNHKPSN TKVDKKVEPKS*CDKTH* |
| SEQ ID NO: 336 | C' terminal-modified huAFD.v1.1 Heavy Chain | EVQLVQSGAEVKKPGASVKVSCKASGYTFTSYYMYWVRQAPGQGLEWIGE INPTQGGTNFNEKFKSRATLTVDTSTSTAYLELSSLRSEDTAVYYCAREGGF AYWGQGTLVTVSSASTKGPSVFPLAPSSKSTSGGTAALGCLVKDYFPEPVTV SWNSGALTSGVHTFPAVLQSSGLYSLSSVVTVPSSSLGTQTYICNVNHKPSN TKVDKKVEPKS*CDKTH* |
| SEQ ID NO: 337 | C' terminal-modified huAFD.v2.2 Heavy Chain | EVQLVQSGAEVKKPGASVKVSCKASGYTFTSYYMYWVRQAPGQGLEWIGE INPTSGDTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDKTH* |
| SEQ ID NO: 338 | C' terminal-modified huAFD.v2.4 Heavy Chain | EVQLVQSGAEVKKPGASVKVSCKASGYTFTSYYMYWVRQAPGQGLEWIGE INPTSGETNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDKTH* |
| SEQ ID NO: 339 | C' terminal-modified huAFD.v2.5 Heavy Chain | EVQLVQSGAEVKKPGASVKVSCKASGYTFTSYYMYWVRQAPGQGLEWIGE INPYSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDKTH* |
| SEQ ID NO: 340 | C' terminal-modified huAFD.v2.6 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDKTH* |
| SEQ ID NO: 341 | C' terminal-modified huAFD.v2.7 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDKTH* |
| SEQ ID NO: 342 | C' terminal-modified huAFD.v2.8 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDKTH* |
| SEQ ID NO: 343 | C' terminal-modified huAFD.v2.9 Heavy Chain | EVQLVQSGAEVKKPGASVKVSCKASGYTFTSYYMYWVRQAPGQGLEWIG WINPTSGGTNFNEKFKSRATLTVDTSTSTAYLELSSLRSEDTAVYYCAREGG FAYWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDKTH* |
| SEQ ID NO: 344 | C' terminal-modified huAFD.v2.10 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDKTH* |
| SEQ ID NO: 345 | C' terminal-modified huAFD.v2.11 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDKTH* |

TABLE 8-continued

Heavy chain and light chain amino acid sequences of C' terminal-modified anti-Factor D antibodies

| SEQ ID NO: 346 | C' terminal-modified huAFD.v2.12 Heavy Chain | EVQLVQSGAEVKKPGASVKVSCKASGYTFTSYYMYWVRQAPGQGLEWIGE INPYSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDKTH* |
|---|---|---|
| SEQ ID NO: 347 | C' terminal-modified huAFD.v2.13 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDKTH* |
| SEQ ID NO: 348 | C' terminal-modified huAFD.v2.14 Heavy Chain | EVQLVQSGAEVKKPGASVKVSCKASGYTFTSYYMYWVRQAPGQGLEWIGE INPTSGETNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDKTH* |
| SEQ ID NO: 349 | C' terminal-modified huAFD.v2.15 Heavy Chain | EVQLVQSGAEVKKPGASVKVSCKASGYTFTSYYMYWVRQAPGQGLEWIGE INPYSGETNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDKTH* |
| SEQ ID NO: 350 | C' terminal-modified AFD WT Heavy Chain | EVQLVQSGPELKKPGASVKVSCKASGYTFTNYGMNWVRQAPGQGLEWMG WINTYTGETTYADDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDKTHTC* |
| SEQ ID NO: 351 | C' terminal-modified AFD.v1 Heavy Chain | EVQLVQSGPELKKPGASVKVSCKASGYTFTNYGMNWVRQAPGQGLEWMG WINTYTGETTYADDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDKTHTC* |
| SEQ ID NO: 352 | C' terminal-modified AFD.v2 Heavy Chain | EVQLVQSGPELKKPGASVKVSCKASGYTFTNYGMNWVRQAPGQGLEWMG WINTYTGETTYADDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDKTHTC* |
| SEQ ID NO: 353 | C' terminal-modified AFD.v3 Heavy Chain | EVQLVQSGPELKKPGASVKVSCKASGYTFTNYGMNWVRQAPGQGLEWMG WINTYTGETTYADDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDKTHTC* |
| SEQ ID NO: 354 | C' terminal-modified AFD.v4 Heavy Chain | EVQLVQSGPELKKPGASVKVSCKASGYTFTNYGMNWVRQAPGQGLEWMG WINTYTGETTYADDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDKTHTC* |
| SEQ ID NO: 355 | C' terminal-modified AFD.v5 Heavy Chain | EVQLVQSGPELKKPGASVKVSCKASGYTFTNYGMNWVRQAPGQGLEWMG WINTYTGETTYADDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDKTHTC* |
| SEQ ID NO: 356 | C' terminal-modified AFD.v6 Heavy Chain | EVQLVQSGPELKKPGASVKVSCKASGYTFTNYGMNWVRQAPGQGLEWMG WINTYTGETTYAEDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDKTHTC* |
| SEQ ID NO: 357 | C' terminal-modified AFD.v7 Heavy Chain | EVQLVQSGPELKKPGASVKVSCKASGYTFTNYGMNWVRQAPGQGLEWMG WINTYTGETTYAEDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDKTHTC* |

TABLE 8-continued

Heavy chain and light chain amino acid sequences of C' terminal-modified anti-Factor D antibodies

| SEQ ID NO: 358 | C' terminal-modified AFD.v8 Heavy Chain | EVQLVQSGPELKKPGASVKVSCKASGYTFTNYGMNWVRQAPGQGLEWMG
WINTYTGETTYAEDFKGRFVFSLDTSVSTAYLQISSLKAEDTAVYYCEREGG
VNNWGQGTLVTVSSASTKGPSVFPLAPSSKSTSGGTAALGCLVKDYFPEPVT
VSWNSGALTSGVHTFPAVLQSSGLYSLSSVVTVPSSSLGTQTYICNVNHKPS
NTKVDKKVEPKS*CDKTHTC* |
| SEQ ID NO: 359 | C' terminal-modified AFD.v9 Heavy Chain | EVQLVQSGPELKKPGASVKVSCKASGYTFTNYGMNWVRQAPGQGLEWMG
WINTYTGETTYAEDFKGRFVFSLDTSVSTAYLQISSLKAEDTAVYYCEREGG
VNNWGQGTLVTVSSASTKGPSVFPLAPSSKSTSGGTAALGCLVKDYFPEPVT
VSWNSGALTSGVHTFPAVLQSSGLYSLSSVVTVPSSSLGTQTYICNVNHKPS
NTKVDKKVEPKS*CDKTHTC* |
| SEQ ID NO: 360 | C' terminal-modified AFD.v10 Heavy Chain | EVQLVQSGPELKKPGASVKVSCKASGYTFTNYGMNWVRQAPGQGLEWMG
WINTYTGETTYAEDFKGRFVFSLDTSVSTAYLQISSLKAEDTAVYYCEREGG
VNNWGQGTLVTVSSASTKGPSVFPLAPSSKSTSGGTAALGCLVKDYFPEPVT
VSWNSGALTSGVHTFPAVLQSSGLYSLSSVVTVPSSSLGTQTYICNVNHKPS
NTKVDKKVEPKS*CDKTHTC* |
| SEQ ID NO: 361 | C' terminal-modified AFD.v11 Heavy Chain | EVQLVQSGPELKKPGASVKVSCKASGYTFTNYGMNWVRQAPGQGLEWMG
WISTYTGETTYAEDFKGRFVFSLDTSVSTAYLQISSLKAEDTAVYYCEREGG
VNNWGQGTLVTVSSASTKGPSVFPLAPSSKSTSGGTAALGCLVKDYFPEPVT
VSWNSGALTSGVHTFPAVLQSSGLYSLSSVVTVPSSSLGTQTYICNVNHKPS
NTKVDKKVEPKS*CDKTHTC* |
| SEQ ID NO: 362 | C' terminal-modified AFD.v12 Heavy Chain | EVQLVQSGPELKKPGASVKVSCKASGYTFTNYGMNWVRQAPGQGLEWMG
WINTYTGETTYAEDFKGRFVFSLDTSVSTAYLQISSLKAEDTAVYYCEREGG
VDNWGQGTLVTVSSASTKGPSVFPLAPSSKSTSGGTAALGCLVKDYFPEPVT
VSWNSGALTSGVHTFPAVLQSSGLYSLSSVVTVPSSSLGTQTYICNVNHKPS
NTKVDKKVEPKS*CDKTHTC* |
| SEQ ID NO: 363 | C' terminal-modified AFD.v13 Heavy Chain | EVQLVQSGPELKKPGASVKVSCKASGYTFTNYGMNWVRQAPGQGLEWMG
WINTYTGETTYAEDFKGRFVFSLDTSVSTAYLQISSLKAEDTAVYYCEREGG
VQNWGQGTLVTVSSASTKGPSVFPLAPSSKSTSGGTAALGCLVKDYFPEPVT
VSWNSGALTSGVHTFPAVLQSSGLYSLSSVVTVPSSSLGTQTYICNVNHKPS
NTKVDKKVEPKS*CDKTHTC* |
| SEQ ID NO: 364 | C' terminal-modified AFD.v14 Heavy Chain | EVQLVQSGPELKKPGASVKVSCKASGYTFTNYGMNWVRQAPGQGLEWMG
WINTYTGETTYAEDFKGRFVFSLDTSVSTAYLQISSLKAEDTAVYYCEREGG
VSNWGQGTLVTVSSASTKGPSVFPLAPSSKSTSGGTAALGCLVKDYFPEPVT
VSWNSGALTSGVHTFPAVLQSSGLYSLSSVVTVPSSSLGTQTYICNVNHKPS
NTKVDKKVEPKS*CDKTHTC* |
| SEQ ID NO: 365 | C' terminal-modified AFD.v15 Heavy Chain | EVQLVQSGPELKKPGASVKVSCKASGYTFTNYGMNWVRQAPGQGLEWMG
WINTYTGETTYAEDFKGRFVFSLDTSVSTAYLQISSLKAEDTAVYYCEREGG
VSNWGQGTLVTVSSASTKGPSVFPLAPSSKSTSGGTAALGCLVKDYFPEPVT
VSWNSGALTSGVHTFPAVLQSSGLYSLSSVVTVPSSSLGTQTYICNVNHKPS
NTKVDKKVEPKS*CDKTHTC* |
| SEQ ID NO: 366 | C' terminal-modified huAFD.v2.0 Heavy Chain | EVQLVQSGAEVKKPGASVKVSCKASGYTFTSYYMYWVRQAPGQGLEWIGE
INPTSGGTNFNEKFKSRATLTVDTSTSTAYLELSSLRSEDTAVYYCAREGGFA
YVVGQGTLVTVSSASTKGPSVFPLAPSSKSTSGGTAALGCLVKDYFPEPVTVS
WNSGALTSGVHTFPAVLQSSGLYSLSSVVTVPSSSLGTQTYICNVNHKPSNT
KVDKKVEPKS*CDKTHTC* |
| SEQ ID NO: 367 | C' terminal-modified huAFD.v2.1 Heavy Chain | EVQLVQSGAEVKKPGASVKVSCKASGYTFTSYYMYWVRQAPGQGLEWIGE
INPTSGGTNFNEKFKSRATLTVDTSTSTAYLELSSLRSEDTAVYYCAREGGFA
YVVGQGTLVTVSSASTKGPSVFPLAPSSKSTSGGTAALGCLVKDYFPEPVTVS
WNSGALTSGVHTFPAVLQSSGLYSLSSVVTVPSSSLGTQTYICNVNHKPSNT
KVDKKVEPKS*CDKTHTC* |
| SEQ ID NO: 368 | C' terminal-modified huAFD.v2.3 Heavy Chain | EVQLVQSGAEVKKPGASVKVSCKASGYTFTSYYMYWVRQAPGQGLEWIGE
INPYSGDTNFNEKFKSRATLTVDTSTSTAYLELSSLRSEDTAVYYCAREGGFA
YVVGQGTLVTVSSASTKGPSVFPLAPSSKSTSGGTAALGCLVKDYFPEPVTVS
WNSGALTSGVHTFPAVLQSSGLYSLSSVVTVPSSSLGTQTYICNVNHKPSNT
KVDKKVEPKS*CDKTHTC* |
| SEQ ID NO: 369 | C' terminal-modified huAFD.v1 Heavy Chain | EVQLVQSGAEVKKPGASVKVSCKASGYTFTSYYMYWVRQAPGQGLEWIGE
INPTNGGTNFNEKFKSRATLTVDTSTSTAYLELSSLRSEDTAVYYCAREGGF
AYWGQGTLVTVSSASTKGPSVFPLAPSSKSTSGGTAALGCLVKDYFPEPVTV
SWNSGALTSGVHTFPAVLQSSGLYSLSSVVTVPSSSLGTQTYICNVNHKPSN
TKVDKKVEPKS*CDKTHTC* |

TABLE 8-continued

Heavy chain and light chain amino acid sequences of C' terminal-modified anti-Factor D antibodies

| SEQ ID NO: 370 | C' terminal-modified huAFD.v1.1 Heavy Chain | EVQLVQSGAEVKKPGASVKVSCKASGYTFTSYYMYWVRQAPGQGLEWIGE INPTQGGTNFNEKFKSRATLTVDTSTSTAYLELSSLRSEDTAVYYCAREGGF AYWGQGTLVTVSSASTKGPSVFPLAPSSKSTSGGTAALGCLVKDYFPEPVTV SWNSGALTSGVHTFPAVLQSSGLYSLSSVVTVPSSSLGTQTYICNVNHKPSN TKVDKKVEPKS*CDKTHTC* |
|---|---|---|
| SEQ ID NO: 371 | C' terminal-modified huAFD.v2.2 Heavy Chain | EVQLVQSGAEVKKPGASVKVSCKASGYTFTSYYMYWVRQAPGQGLEWIGE INPTSGDTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDKTHTC* |
| SEQ ID NO: 372 | C' terminal-modified huAFD.v2.4 Heavy Chain | EVQLVQSGAEVKKPGASVKVSCKASGYTFTSYYMYWVRQAPGQGLEWIGE INPTSGETNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDKTHTC* |
| SEQ ID NO: 373 | C' terminal-modified huAFD.v2.5 Heavy Chain | EVQLVQSGAEVKKPGASVKVSCKASGYTFTSYYMYWVRQAPGQGLEWIGE INPYSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDKTHTC* |
| SEQ ID NO: 374 | C' terminal-modified huAFD.v2.6 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDKTHTC* |
| SEQ ID NO: 375 | C' terminal-modified huAFD.v2.7 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDKTHTC* |
| SEQ ID NO: 376 | C' terminal-modified huAFD.v2.8 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDKTHTC* |
| SEQ ID NO: 377 | C' terminal-modified huAFD.v2.9 Heavy | EVQLVQSGAEVKKPGASVKVSCKASGYTFTSYYMYWVRQAPGQGLEWIG WINPTSGGTNFNEKFKSRATLTVDTSTSTAYLELSSLRSEDTAVYYCAREGG FAYWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDKTHTC* |
| SEQ ID NO: 378 | C' terminal-modified huAFD.v2.10 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDKTHTC* |
| SEQ ID NO: 379 | C' terminal-modified huAFD.v2.11 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDKTHTC* |
| SEQ ID NO: 380 | C' terminal-modified huAFD.v2.12 Heavy Chain | EVQLVQSGAEVKKPGASVKVSCKASGYTFTSYYMYWVRQAPGQGLEWIGE INPYSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDKTHTC* |
| SEQ ID NO: 381 | C' terminal-modified huAFD.v2.13 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDKTHTC* |

TABLE 8-continued

Heavy chain and light chain amino acid sequences of C' terminal-modified anti-Factor D antibodies

| SEQ ID NO: 382 | C' terminal-modified huAFD.v2.14 Heavy Chain | EVQLVQSGAEVKKPGASVKVSCKASGYTFTSYYMYWVRQAPGQGLEWIGE INPTSGETNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDKTHTC* |
|---|---|---|
| SEQ ID NO: 383 | C' terminal-modified huAFD.v2.15 Heavy Chain | EVQLVQSGAEVKKPGASVKVSCKASGYTFTSYYMYWVRQAPGQGLEWIGE INPYSGETNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDKTHTC* |
| SEQ ID NO: 384 | C' terminal-modified AFD WT Heavy Chain | EVQLVQSGPELKKPGASVKVSCKASGYTFTNYGMNWVRQAPGQGLEWMG WINTYTGETTYADDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDKTHTCPPC* |
| SEQ ID NO: 385 | C' terminal-modified AFD.v1 Heavy Chain | EVQLVQSGPELKKPGASVKVSCKASGYTFTNYGMNWVRQAPGQGLEWMG WINTYTGETTYADDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDKTHTCPPC* |
| SEQ ID NO: 386 | C' terminal-modified AFD.v2 Heavy Chain | EVQLVQSGPELKKPGASVKVSCKASGYTFTNYGMNWVRQAPGQGLEWMG WINTYTGETTYADDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDKTHTCPPC* |
| SEQ ID NO: 387 | C' terminal-modified AFD.v3 Heavy Chain | EVQLVQSGPELKKPGASVKVSCKASGYTFTNYGMNWVRQAPGQGLEWMG WINTYTGETTYADDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDKTHTCPPC* |
| SEQ ID NO: 388 | C' terminal-modified AFD.v4 Heavy Chain | EVQLVQSGPELKKPGASVKVSCKASGYTFTNYGMNWVRQAPGQGLEWMG WINTYTGETTYADDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDKTHTCPPC* |
| SEQ ID NO: 389 | C' terminal-modified AFD.v5 Heavy Chain | EVQLVQSGPELKKPGASVKVSCKASGYTFTNYGMNWVRQAPGQGLEWMG WINTYTGETTYADDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDKTHTCPPC* |
| SEQ ID NO: 390 | C' terminal-modified AFD.v6 Heavy Chain | EVQLVQSGPELKKPGASVKVSCKASGYTFTNYGMNWVRQAPGQGLEWMG WINTYTGETTYAEDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDKTHTCPPC* |
| SEQ ID NO: 391 | C' terminal-modified AFD.v7 Heavy Chain | EVQLVQSGPELKKPGASVKVSCKASGYTFTNYGMNWVRQAPGQGLEWMG WINTYTGETTYAEDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDKTHTCPPC* |
| SEQ ID NO: 392 | C' terminal-modified AFD.v8 Heavy Chain | EVQLVQSGPELKKPGASVKVSCKASGYTFTNYGMNWVRQAPGQGLEWMG WINTYTGETTYAEDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDKTHTCPPC* |
| SEQ ID NO: 393 | C' terminal-modified AFD.v9 Heavy Chain | EVQLVQSGPELKKPGASVKVSCKASGYTFTNYGMNWVRQAPGQGLEWMG WINTYTGETTYAEDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDKTHTCPPC* |
| SEQ ID NO: 394 | C' terminal-modified AFD.v10 Heavy Chain | EVQLVQSGPELKKPGASVKVSCKASGYTFTNYGMNWVRQAPGQGLEWMG WINTYTGETTYAEDFKGRFVFSLDTSVSTAYLQISSLKAEDTAVYYCEREGG |

TABLE 8-continued

Heavy chain and light chain amino acid sequences of C' terminal-modified anti-Factor D antibodies

| | | |
|---|---|---|
| | | VNNWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKS*CDKTHTCPPC* |
| SEQ ID<br>NO: 395 | C' terminal-modified<br>AFD.v11 Heavy Chain | EVQLVQSGPELKKPGASVKVSCKASGYTFTNYGMNWVRQAPGQGLEWMG<br>WISTYTGETTYAEDFKGRFVFSLDTSVSTAYLQISSLKAEDTAVYYCEREGG<br>VNNWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKS*CDKTHTCPPC* |
| SEQ ID<br>NO: 396 | C' terminal-modified<br>AFD.v12 Heavy Chain | EVQLVQSGPELKKPGASVKVSCKASGYTFTNYGMNWVRQAPGQGLEWMG<br>WINTYTGETTYAEDFKGRFVFSLDTSVSTAYLQISSLKAEDTAVYYCEREGG<br>VDNWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKS*CDKTHTCPPC* |
| SEQ ID<br>NO: 397 | C' terminal-modified<br>AFD.v13 Heavy Chain | EVQLVQSGPELKKPGASVKVSCKASGYTFTNYGMNWVRQAPGQGLEWMG<br>WINTYTGETTYAEDFKGRFVFSLDTSVSTAYLQISSLKAEDTAVYYCEREGG<br>VQNWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKS*CDKTHTCPPC* |
| SEQ ID<br>NO: 398 | C' terminal-modified<br>AFD.v14 Heavy Chain | EVQLVQSGPELKKPGASVKVSCKASGYTFTNYGMNWVRQAPGQGLEWMG<br>WINTYTGETTYAEDFKGRFVFSLDTSVSTAYLQISSLKAEDTAVYYCEREGG<br>VSNWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKS*CDKTHTCPPC* |
| SEQ ID<br>NO: 399 | C' terminal-modified<br>AFD.v15 Heavy Chain | EVQLVQSGPELKKPGASVKVSCKASGYTFTNYGMNWVRQAPGQGLEWMG<br>WINTYTGETTYAEDFKGRFVFSLDTSVSTAYLQISSLKAEDTAVYYCEREGG<br>VSNWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKS*CDKTHTCPPC* |
| SEQ ID<br>NO: 400 | C' terminal-modified<br>huAFD.v2.0 Heavy<br>Chain | EVQLVQSGAEVKKPGASVKVSCKASGYTFTSYYMYWVRQAPGQGLEWIGE<br>INPTSGGTNFNEKFKSRATLTVDTSTSTAYLELSSLRSEDTAVYYCAREGGFA<br>YVVGQGTLVTVSSASTKGPSVFPLAPSSKSTSGGTAALGCLVKDYFPEPVTVS<br>WNSGALTSGVHTFPAVLQSSGLYSLSSVVTVPSSSLGTQTYICNVNHKPSNT<br>KVDKKVEPKS*CDKTHTCPPC* |
| SEQ ID<br>NO: 401 | C' terminal-modified<br>huAFD.v2.1 Heavy<br>Chain | EVQLVQSGAEVKKPGASVKVSCKASGYTFTSYYMYWVRQAPGQGLEWIGE<br>INPTSGGTNFNEKFKSRATLTVDTSTSTAYLELSSLRSEDTAVYYCAREGGFA<br>YVVGQGTLVTVSSASTKGPSVFPLAPSSKSTSGGTAALGCLVKDYFPEPVTVS<br>WNSGALTSGVHTFPAVLQSSGLYSLSSVVTVPSSSLGTQTYICNVNHKPSNT<br>KVDKKVEPKS*CDKTHTCPPC* |
| SEQ ID<br>NO: 402 | C' terminal-modified<br>huAFD.v2.3 Heavy<br>Chain | EVQLVQSGAEVKKPGASVKVSCKASGYTFTSYYMYWVRQAPGQGLEWIGE<br>INPYSGDTNFNEKFKSRATLTVDTSTSTAYLELSSLRSEDTAVYYCAREGGFA<br>YVVGQGTLVTVSSASTKGPSVFPLAPSSKSTSGGTAALGCLVKDYFPEPVTVS<br>WNSGALTSGVHTFPAVLQSSGLYSLSSVVTVPSSSLGTQTYICNVNHKPSNT<br>KVDKKVEPKS*CDKTHTCPPC* |
| SEQ ID<br>NO: 403 | C' terminal-modified<br>huAFD.v1 Heavy<br>Chain | EVQLVQSGAEVKKPGASVKVSCKASGYTFTSYYMYWVRQAPGQGLEWIGE<br>INPTNGGTNFNEKFKSRATLTVDTSTSTAYLELSSLRSEDTAVYYCAREGGF<br>AYWGQGTLVTVSSASTKGPSVFPLAPSSKSTSGGTAALGCLVKDYFPEPVTV<br>SWNSGALTSGVHTFPAVLQSSGLYSLSSVVTVPSSSLGTQTYICNVNHKPSN<br>TKVDKKVEPKS*CDKTHTCPPC* |
| SEQ ID<br>NO: 404 | C' terminal-modified<br>huAFD.v1.1 Heavy<br>Chain | EVQLVQSGAEVKKPGASVKVSCKASGYTFTSYYMYWVRQAPGQGLEWIGE<br>INPTQGGTNFNEKFKSRATLTVDTSTSTAYLELSSLRSEDTAVYYCAREGGF<br>AYWGQGTLVTVSSASTKGPSVFPLAPSSKSTSGGTAALGCLVKDYFPEPVTV<br>SWNSGALTSGVHTFPAVLQSSGLYSLSSVVTVPSSSLGTQTYICNVNHKPSN<br>TKVDKKVEPKS*CDKTHTCPPC* |
| SEQ ID<br>NO: 405 | C' terminal-modified<br>huAFD.v2.2 Heavy<br>Chain | EVQLVQSGAEVKKPGASVKVSCKASGYTFTSYYMYWVRQAPGQGLEWIGE<br>INPTSGDTNFNEKFKSRATLTVDTSTSTAYLELSSLRSEDTAVYYCAREGGFA<br>YVVGQGTLVTVSSASTKGPSVFPLAPSSKSTSGGTAALGCLVKDYFPEPVTVS<br>WNSGALTSGVHTFPAVLQSSGLYSLSSVVTVPSSSLGTQTYICNVNHKPSNT<br>KVDKKVEPKS*CDKTHTCPPC* |
| SEQ ID<br>NO: 406 | C' terminal-modified<br>huAFD.v2.4 Heavy<br>Chain | EVQLVQSGAEVKKPGASVKVSCKASGYTFTSYYMYWVRQAPGQGLEWIGE<br>INPTSGETNFNEKFKSRATLTVDTSTSTAYLELSSLRSEDTAVYYCAREGGFA<br>YVVGQGTLVTVSSASTKGPSVFPLAPSSKSTSGGTAALGCLVKDYFPEPVTVS<br>WNSGALTSGVHTFPAVLQSSGLYSLSSVVTVPSSSLGTQTYICNVNHKPSNT<br>KVDKKVEPKS*CDKTHTCPPC* |

TABLE 8-continued

Heavy chain and light chain amino acid sequences of C' terminal-modified anti-Factor D antibodies

| SEQ ID NO: 407 | C' terminal-modified huAFD.v2.5 Heavy Chain | EVQLVQSGAEVKKPGASVKVSCKASGYTFTSYYMYWVRQAPGQGLEWIGE INPYSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDKTHTCPPC* |
|---|---|---|
| SEQ ID NO: 408 | C' terminal-modified huAFD.v2.6 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDKTHTCPPC* |
| SEQ ID NO: 409 | C' terminal-modified huAFD.v2.7 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDKTHTCPPC* |
| SEQ ID NO: 410 | C' terminal-modified huAFD.v2.8 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDKTHTCPPC* |
| SEQ ID NO: 411 | C' terminal-modified huAFD.v2.9 Heavy Chain | EVQLVQSGAEVKKPGASVKVSCKASGYTFTSYYMYWVRQAPGQGLEWIG WINPTSGGTNFNEKFKSRATLTVDTSTSTAYLELSSLRSEDTAVYYCAREGG FAYWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDKTHTCPPC* |
| SEQ ID NO: 412 | C' terminal-modified huAFD.v2.10 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDKTHTCPPC* |
| SEQ ID NO: 413 | C' terminal-modified huAFD.v2.11 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDKTHTCPPC* |
| SEQ ID NO: 414 | C' terminal-modified huAFD.v2.12 Heavy Chain | EVQLVQSGAEVKKPGASVKVSCKASGYTFTSYYMYWVRQAPGQGLEWIGE INPYSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDKTHTCPPC* |
| SEQ ID NO: 415 | C' terminal-modified huAFD.v2.13 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDKTHTCPPC* |
| SEQ ID NO: 416 | C' terminal-modified huAFD.v2.14 Heavy Chain | EVQLVQSGAEVKKPGASVKVSCKASGYTFTSYYMYWVRQAPGQGLEWIGE INPTSGETNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDKTHTCPPC* |
| SEQ ID NO: 417 | C' terminal-modified huAFD.v2.15 Heavy Chain | EVQLVQSGAEVKKPGASVKVSCKASGYTFTSYYMYWVRQAPGQGLEWIGE INPYSGETNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDKTHTCPPC* |
| SEQ ID NO: 418 | C' terminal-modified AFD WT Heavy Chain | EVQLVQSGPELKKPGASVKVSCKASGYTFTNYGMNWVRQAPGQGLEWMG WINTYTGETTYADDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDKTHTCPPS* |
| SEQ ID NO: 419 | C' terminal-modified AFD.v1 Heavy Chain | EVQLVQSGPELKKPGASVKVSCKASGYTFTNYGMNWVRQAPGQGLEWMG WINTYTGETTYADDFKGRFVFSLDTSVSTAYLQISSLKAEDTAVYYCEREGG |

TABLE 8-continued

Heavy chain and light chain amino acid sequences of C' terminal-modified anti-Factor D antibodies

| SEQ ID NO: 420 | C' terminal-modified AFD.v2 Heavy Chain | VNNWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKS*CDKTHTCPPS* |
|---|---|---|
| SEQ ID NO: 420 | C' terminal-modified AFD.v2 Heavy Chain | EVQLVQSGPELKKPGASVKVSCKASGYTFTNYGMNWVRQAPGQGLEWMG<br>WINTYTGETTYADDFKGRFVFSLDTSVSTAYLQISSLKAEDTAVYYCEREGG<br>VNNWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKS*CDKTHTCPPS* |
| SEQ ID NO: 421 | C' terminal-modified AFD.v3 Heavy Chain | EVQLVQSGPELKKPGASVKVSCKASGYTFTNYGMNWVRQAPGQGLEWMG<br>WINTYTGETTYADDFKGRFVFSLDTSVSTAYLQISSLKAEDTAVYYCEREGG<br>VNNWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKS*CDKTHTCPPS* |
| SEQ ID NO: 422 | C' terminal-modified AFD.v4 Heavy Chain | EVQLVQSGPELKKPGASVKVSCKASGYTFTNYGMNWVRQAPGQGLEWMG<br>WINTYTGETTYADDFKGRFVFSLDTSVSTAYLQISSLKAEDTAVYYCEREGG<br>VNNWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKS*CDKTHTCPPS* |
| SEQ ID NO: 423 | C' terminal-modified AFD.v5 Heavy Chain | EVQLVQSGPELKKPGASVKVSCKASGYTFTNYGMNWVRQAPGQGLEWMG<br>WINTYTGETTYADDFKGRFVFSLDTSVSTAYLQISSLKAEDTAVYYCEREGG<br>VNNWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKS*CDKTHTCPPS* |
| SEQ ID NO: 424 | C' terminal-modified AFD.v6 Heavy Chain | EVQLVQSGPELKKPGASVKVSCKASGYTFTNYGMNWVRQAPGQGLEWMG<br>WINTYTGETTYAEDFKGRFVFSLDTSVSTAYLQISSLKAEDTAVYYCEREGG<br>VNNWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKS*CDKTHTCPPS* |
| SEQ ID NO: 425 | C' terminal-modified AFD.v7 Heavy Chain | EVQLVQSGPELKKPGASVKVSCKASGYTFTNYGMNWVRQAPGQGLEWMG<br>WINTYTGETTYAEDFKGRFVFSLDTSVSTAYLQISSLKAEDTAVYYCEREGG<br>VNNWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKS*CDKTHTCPPS* |
| SEQ ID NO: 426 | C' terminal-modified AFD.v8 Heavy Chain | EVQLVQSGPELKKPGASVKVSCKASGYTFTNYGMNWVRQAPGQGLEWMG<br>WINTYTGETTYAEDFKGRFVFSLDTSVSTAYLQISSLKAEDTAVYYCEREGG<br>VNNWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKS*CDKTHTCPPS* |
| SEQ ID NO: 427 | C' terminal-modified AFD.v9 Heavy Chain | EVQLVQSGPELKKPGASVKVSCKASGYTFTNYGMNWVRQAPGQGLEWMG<br>WINTYTGETTYAEDFKGRFVFSLDTSVSTAYLQISSLKAEDTAVYYCEREGG<br>VNNWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKS*CDKTHTCPPS* |
| SEQ ID NO: 428 | C' terminal-modified AFD.v10 Heavy Chain | EVQLVQSGPELKKPGASVKVSCKASGYTFTNYGMNWVRQAPGQGLEWMG<br>WINTYTGETTYAEDFKGRFVFSLDTSVSTAYLQISSLKAEDTAVYYCEREGG<br>VNNWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKS*CDKTHTCPPS* |
| SEQ ID NO: 429 | C' terminal-modified AFD.v11 Heavy Chain | EVQLVQSGPELKKPGASVKVSCKASGYTFTNYGMNWVRQAPGQGLEWMG<br>WISTYTGETTYAEDFKGRFVFSLDTSVSTAYLQISSLKAEDTAVYYCEREGG<br>VNNWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKS*CDKTHTCPPS* |
| SEQ ID NO: 430 | C' terminal-modified AFD.v12 Heavy Chain | EVQLVQSGPELKKPGASVKVSCKASGYTFTNYGMNWVRQAPGQGLEWMG<br>WINTYTGETTYAEDFKGRFVFSLDTSVSTAYLQISSLKAEDTAVYYCEREGG<br>VDNWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKS*CDKTHTCPPS* |
| SEQ ID NO: 431 | C' terminal-modified AFD.v13 Heavy Chain | EVQLVQSGPELKKPGASVKVSCKASGYTFTNYGMNWVRQAPGQGLEWMG<br>WINTYTGETTYAEDFKGRFVFSLDTSVSTAYLQISSLKAEDTAVYYCEREGG<br>VQNWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKS*CDKTHTCPPS* |

TABLE 8-continued

Heavy chain and light chain amino acid sequences of C' terminal-modified anti-Factor D antibodies

| SEQ ID NO: 432 | C' terminal-modified AFD.v14 Heavy Chain | EVQLVQSGPELKKPGASVKVSCKASGYTFTNYGMNWVRQAPGQGLEWMG WINTYTGETTYAEDFKGRFVFSLDTSVSTAYLQISSLKAEDTAVYYCEREGG VSNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDKTHTCPPS* |
|---|---|---|
| SEQ ID NO: 433 | C' terminal-modified AFD.v15 Heavy Chain | EVQLVQSGPELKKPGASVKVSCKASGYTFTNYGMNWVRQAPGQGLEWMG WINTYTGETTYAEDFKGRFVFSLDTSVSTAYLQISSLKAEDTAVYYCEREGG VSNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDKTHTCPPS* |
| SEQ ID NO: 434 | C' terminal-modified huAFD.v2.0 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDKTHTCPPS* |
| SEQ ID NO: 435 | C' terminal-modified huAFD.v2.1 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDKTHTCPPS* |
| SEQ ID NO: 436 | C' terminal-modified huAFD.v2.3 Heavy Chain | EVQLVQSGAEVKKPGASVKVSCKASGYTFTSYYMYWVRQAPGQGLEWIGE INPYSGDTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDKTHTCPPS* |
| SEQ ID NO: 437 | C' terminal-modified huAFD.v1 Heavy Chain | EVQLVQSGAEVKKPGASVKVSCKASGYTFTSYYMYWVRQAPGQGLEWIGE INPTNGGTNFNEKFKSRATLTVDTSTSTAYLELSSLRSEDTAVYYCAREGGF AYWGQGTLVTVSSASTKGPSVFPLAPSSKSTSGGTAALGCLVKDYFPEPVTV SWNSGALTSGVHTFPAVLQSSGLYSLSSVVTVPSSSLGTQTYICNVNHKPSN TKVDKKVEPKS*CDKTHTCPPS* |
| SEQ ID NO: 438 | C' terminal-modified huAFD.v1.1 Heavy Chain | EVQLVQSGAEVKKPGASVKVSCKASGYTFTSYYMYWVRQAPGQGLEWIGE INPTQGGTNFNEKFKSRATLTVDTSTSTAYLELSSLRSEDTAVYYCAREGGF AYWGQGTLVTVSSASTKGPSVFPLAPSSKSTSGGTAALGCLVKDYFPEPVTV SWNSGALTSGVHTFPAVLQSSGLYSLSSVVTVPSSSLGTQTYICNVNHKPSN TKVDKKVEPKS*CDKTHTCPPS* |
| SEQ ID NO: 439 | C' terminal-modified huAFD.v2.2 Heavy Chain | EVQLVQSGAEVKKPGASVKVSCKASGYTFTSYYMYWVRQAPGQGLEWIGE INPTSGDTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDKTHTCPPS* |
| SEQ ID NO: 440 | C' terminal-modified huAFD.v2.4 Heavy Chain | EVQLVQSGAEVKKPGASVKVSCKASGYTFTSYYMYWVRQAPGQGLEWIGE INPTSGETNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDKTHTCPPS* |
| SEQ ID NO: 441 | C' terminal-modified huAFD.v2.5 Heavy Chain | EVQLVQSGAEVKKPGASVKVSCKASGYTFTSYYMYWVRQAPGQGLEWIGE INPYSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDKTHTCPPS* |
| SEQ ID NO: 442 | C' terminal-modified huAFD.v2.6 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDKTHTCPPS* |
| SEQ ID NO: 443 | C' terminal-modified huAFD.v2.7 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDKTHTCPPS* |
| SEQ ID NO: 444 | C' terminal-modified huAFD.v2.8 Heavy | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA |

TABLE 8-continued

Heavy chain and light chain amino acid sequences of C' terminal-modified anti-Factor D antibodies

| | | |
|---|---|---|
| | Chain | YVVGQGTLVTVSSASTKGPSVFPLAPSSKSTSGGTAALGCLVKDYFPEPVTVS<br>WNSGALTSGVHTFPAVLQSSGLYSLSSVVTVPSSSLGTQTYICNVNHKPSNT<br>KVDKKVEPKS*CDKTHTCPPS* |
| SEQ ID<br>NO: 445 | C' terminal-modified<br>huAFD.v2.9 Heavy<br>Chain | EVQLVQSGAEVKKPGASVKVSCKASGYTFTSYYMYWVRQAPGQGLEWIG<br>WINPTSGGTNFNEKFKSRATLTVDTSTSTAYLELSSLRSEDTAVYYCAREGG<br>FAYWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKS*CDKTHTCPPS* |
| SEQ ID<br>NO: 446 | C' terminal-modified<br>huAFD.v2.10 Heavy<br>Chain | EVQLVQSGAEVKKPGASVKVSCKASGYTFTSYYMYWVRQAPGQGLEWIGE<br>INPTSGGTNFNEKFKSRATLTVDTSTSTAYLELSSLRSEDTAVYYCAREGGFA<br>YVVGQGTLVTVSSASTKGPSVFPLAPSSKSTSGGTAALGCLVKDYFPEPVTVS<br>WNSGALTSGVHTFPAVLQSSGLYSLSSVVTVPSSSLGTQTYICNVNHKPSNT<br>KVDKKVEPKS*CDKTHTCPPS* |
| SEQ ID<br>NO: 447 | C' terminal-modified<br>huAFD.v2.11 Heavy<br>Chain | EVQLVQSGAEVKKPGASVKVSCKASGYTFTSYYMYWVRQAPGQGLEWIGE<br>INPTSGGTNFNEKFKSRATLTVDTSTSTAYLELSSLRSEDTAVYYCAREGGFA<br>YVVGQGTLVTVSSASTKGPSVFPLAPSSKSTSGGTAALGCLVKDYFPEPVTVS<br>WNSGALTSGVHTFPAVLQSSGLYSLSSVVTVPSSSLGTQTYICNVNHKPSNT<br>KVDKKVEPKS*CDKTHTCPPS* |
| SEQ ID<br>NO: 448 | C' terminal-modified<br>huAFD.v2.12 Heavy<br>Chain | EVQLVQSGAEVKKPGASVKVSCKASGYTFTSYYMYWVRQAPGQGLEWIGE<br>INPYSGGTNFNEKFKSRATLTVDTSTSTAYLELSSLRSEDTAVYYCAREGGFA<br>YVVGQGTLVTVSSASTKGPSVFPLAPSSKSTSGGTAALGCLVKDYFPEPVTVS<br>WNSGALTSGVHTFPAVLQSSGLYSLSSVVTVPSSSLGTQTYICNVNHKPSNT<br>KVDKKVEPKS*CDKTHTCPPS* |
| SEQ ID<br>NO: 449 | C' terminal-modified<br>huAFD.v2.13 Heavy<br>Chain | EVQLVQSGAEVKKPGASVKVSCKASGYTFTSYYMYWVRQAPGQGLEWIGE<br>INPTSGGTNFNEKFKSRATLTVDTSTSTAYLELSSLRSEDTAVYYCAREGGFA<br>YVVGQGTLVTVSSASTKGPSVFPLAPSSKSTSGGTAALGCLVKDYFPEPVTVS<br>WNSGALTSGVHTFPAVLQSSGLYSLSSVVTVPSSSLGTQTYICNVNHKPSNT<br>KVDKKVEPKS*CDKTHTCPPS* |
| SEQ ID<br>NO: 450 | C' terminal-modified<br>huAFD.v2.14 Heavy<br>Chain | EVQLVQSGAEVKKPGASVKVSCKASGYTFTSYYMYWVRQAPGQGLEWIGE<br>INPTSGETNFNEKFKSRATLTVDTSTSTAYLELSSLRSEDTAVYYCAREGGFA<br>YVVGQGTLVTVSSASTKGPSVFPLAPSSKSTSGGTAALGCLVKDYFPEPVTVS<br>WNSGALTSGVHTFPAVLQSSGLYSLSSVVTVPSSSLGTQTYICNVNHKPSNT<br>KVDKKVEPKS*CDKTHTCPPS* |
| SEQ ID<br>NO: 451 | C' terminal-modified<br>huAFD.v2.15 Heavy<br>Chain | EVQLVQSGAEVKKPGASVKVSCKASGYTFTSYYMYWVRQAPGQGLEWIGE<br>INPYSGETNFNEKFKSRATLTVDTSTSTAYLELSSLRSEDTAVYYCAREGGFA<br>YVVGQGTLVTVSSASTKGPSVFPLAPSSKSTSGGTAALGCLVKDYFPEPVTVS<br>WNSGALTSGVHTFPAVLQSSGLYSLSSVVTVPSSSLGTQTYICNVNHKPSNT<br>KVDKKVEPKS*CDKTHTCPPS* |
| SEQ ID<br>NO: 452 | C' terminal-modified<br>AFD WT Heavy Chain | EVQLVQSGPELKKPGASVKVSCKASGYTFTNYGMNWVRQAPGQGLEWMG<br>WINTYTGETTYADDFKGRFVFSLDTSVSTAYLQISSLKAEDTAVYYCEREGG<br>VNNWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKS*CDKTHTSPPC* |
| SEQ ID<br>NO: 453 | C' terminal-modified<br>AFD.v1 Heavy Chain | EVQLVQSGPELKKPGASVKVSCKASGYTFTNYGMNWVRQAPGQGLEWMG<br>WINTYTGETTYADDFKGRFVFSLDTSVSTAYLQISSLKAEDTAVYYCEREGG<br>VNNWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKS*CDKTHTSPPC* |
| SEQ ID<br>NO: 454 | C' terminal-modified<br>AFD.v2 Heavy Chain | EVQLVQSGPELKKPGASVKVSCKASGYTFTNYGMNWVRQAPGQGLEWMG<br>WINTYTGETTYADDFKGRFVFSLDTSVSTAYLQISSLKAEDTAVYYCEREGG<br>VNNWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKS*CDKTHTSPPC* |
| SEQ ID<br>NO: 455 | C' terminal-modified<br>AFD.v3 Heavy Chain | EVQLVQSGPELKKPGASVKVSCKASGYTFTNYGMNWVRQAPGQGLEWMG<br>WINTYTGETTYADDFKGRFVFSLDTSVSTAYLQISSLKAEDTAVYYCEREGG<br>VNNWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKS*CDKTHTSPPC* |
| SEQ ID<br>NO: 456 | C' terminal-modified<br>AFD.v4 Heavy Chain | EVQLVQSGPELKKPGASVKVSCKASGYTFTNYGMNWVRQAPGQGLEWMG<br>WINTYTGETTYADDFKGRFVFSLDTSVSTAYLQISSLKAEDTAVYYCEREGG<br>VNNWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKS*CDKTHTSPPC* |

TABLE 8-continued

Heavy chain and light chain amino acid sequences of C' terminal-modified anti-Factor D antibodies

| SEQ ID NO: 457 | C' terminal-modified AFD.v5 Heavy Chain | EVQLVQSGPELKKPGASVKVSCKASGYTFTNYGMNWVRQAPGQGLEWMG WINTYTGETTYADDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDKTHTSPPC* |
|---|---|---|
| SEQ ID NO: 458 | C' terminal-modified AFD.v6 Heavy Chain | EVQLVQSGPELKKPGASVKVSCKASGYTFTNYGMNWVRQAPGQGLEWMG WINTYTGETTYAEDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDKTHTSPPC* |
| SEQ ID NO: 459 | C' terminal-modified AFD.v7 Heavy Chain | EVQLVQSGPELKKPGASVKVSCKASGYTFTNYGMNWVRQAPGQGLEWMG WINTYTGETTYAEDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDKTHTSPPC* |
| SEQ ID NO: 460 | C' terminal-modified AFD.v8 Heavy Chain | EVQLVQSGPELKKPGASVKVSCKASGYTFTNYGMNWVRQAPGQGLEWMG WINTYTGETTYAEDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDKTHTSPPC* |
| SEQ ID NO: 461 | C' terminal-modified AFD.v9 Heavy Chain | EVQLVQSGPELKKPGASVKVSCKASGYTFTNYGMNWVRQAPGQGLEWMG WINTYTGETTYAEDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDKTHTSPPC* |
| SEQ ID NO: 462 | C' terminal-modified AFD.v10 Heavy Chain | EVQLVQSGPELKKPGASVKVSCKASGYTFTNYGMNWVRQAPGQGLEWMG WINTYTGETTYAEDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDKTHTSPPC* |
| SEQ ID NO: 463 | C' terminal-modified AFD.v11 Heavy Chain | EVQLVQSGPELKKPGASVKVSCKASGYTFTNYGMNWVRQAPGQGLEWMG WISTYTGETTYAEDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDKTHTSPPC* |
| SEQ ID NO: 464 | C' terminal-modified AFD.v12 Heavy Chain | EVQLVQSGPELKKPGASVKVSCKASGYTFTNYGMNWVRQAPGQGLEWMG WINTYTGETTYAEDFKGRFVFSLDTSVSTAYLQISSLKAEDTAVYYCEREGG VDNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDKTHTSPPC* |
| SEQ ID NO: 465 | C' terminal-modified AFD.v13 Heavy Chain | EVQLVQSGPELKKPGASVKVSCKASGYTFTNYGMNWVRQAPGQGLEWMG WINTYTGETTYAEDFKGRFVFSLDTSVSTAYLQISSLKAEDTAVYYCEREGG VQNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDKTHTSPPC* |
| SEQ ID NO: 466 | C' terminal-modified AFD.v14 Heavy Chain | EVQLVQSGPELKKPGASVKVSCKASGYTFTNYGMNWVRQAPGQGLEWMG WINTYTGETTYAEDFKGRFVFSLDTSVSTAYLQISSLKAEDTAVYYCEREGG VSNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDKTHTSPPC* |
| SEQ ID NO: 467 | C' terminal-modified AFD.v15 Heavy Chain | EVQLVQSGPELKKPGASVKVSCKASGYTFTNYGMNWVRQAPGQGLEWMG WINTYTGETTYAEDFKGRFVFSLDTSVSTAYLQISSLKAEDTAVYYCEREGG VSNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDKTHTSPPC* |
| SEQ ID NO: 468 | C' terminal-modified huAFD.v2.0 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDKTHTSPPC* |
| SEQ ID NO: 469 | C' terminal-modified huAFD.v2.1 Heavy | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA |

TABLE 8-continued

Heavy chain and light chain amino acid sequences of C' terminal-modified anti-Factor D antibodies

| | | |
|---|---|---|
| | Chain | YVVGQGTLVTVSSASTKGPSVFPLAPSSKSTSGGTAALGCLVKDYFPEPVTVS
WNSGALTSGVHTFPAVLQSSGLYSLSSVVTVPSSSLGTQTYICNVNHKPSNT
KVDKKVEPKS*CDKTHTSPPC* |
| SEQ ID NO: 470 | C' terminal-modified huAFD.v2.3 Heavy Chain | EVQLVQSGAEVKKPGASVKVSCKASGYTFTSYYMYWVRQAPGQGLEWIGE
INPYSGDTNFNEKFKSRATLTVDTSTSTAYLELSSLRSEDTAVYYCAREGGFA
YVVGQGTLVTVSSASTKGPSVFPLAPSSKSTSGGTAALGCLVKDYFPEPVTVS
WNSGALTSGVHTFPAVLQSSGLYSLSSVVTVPSSSLGTQTYICNVNHKPSNT
KVDKKVEPKS*CDKTHTSPPC* |
| SEQ ID NO: 471 | C' terminal-modified huAFD.v1 Heavy Chain | EVQLVQSGAEVKKPGASVKVSCKASGYTFTSYYMYWVRQAPGQGLEWIGE
INPTNGGTNFNEKFKSRATLTVDTSTSTAYLELSSLRSEDTAVYYCAREGGF
AYWGQGTLVTVSSASTKGPSVFPLAPSSKSTSGGTAALGCLVKDYFPEPVTV
SWNSGALTSGVHTFPAVLQSSGLYSLSSVVTVPSSSLGTQTYICNVNHKPSN
TKVDKKVEPKS*CDKTHTSPPC* |
| SEQ ID NO: 472 | C' terminal-modified huAFD.v1.1 Heavy Chain | EVQLVQSGAEVKKPGASVKVSCKASGYTFTSYYMYWVRQAPGQGLEWIGE
INPTQGGTNFNEKFKSRATLTVDTSTSTAYLELSSLRSEDTAVYYCAREGGF
AYWGQGTLVTVSSASTKGPSVFPLAPSSKSTSGGTAALGCLVKDYFPEPVTV
SWNSGALTSGVHTFPAVLQSSGLYSLSSVVTVPSSSLGTQTYICNVNHKPSN
TKVDKKVEPKS*CDKTHTSPPC* |
| SEQ ID NO: 473 | C' terminal-modified huAFD.v2.2 Heavy Chain | EVQLVQSGAEVKKPGASVKVSCKASGYTFTSYYMYWVRQAPGQGLEWIGE
INPTSGDTNFNEKFKSRATLTVDTSTSTAYLELSSLRSEDTAVYYCAREGGFA
YVVGQGTLVTVSSASTKGPSVFPLAPSSKSTSGGTAALGCLVKDYFPEPVTVS
WNSGALTSGVHTFPAVLQSSGLYSLSSVVTVPSSSLGTQTYICNVNHKPSNT
KVDKKVEPKS*CDKTHTSPPC* |
| SEQ ID NO: 474 | C' terminal-modified huAFD.v2.4 Heavy Chain | EVQLVQSGAEVKKPGASVKVSCKASGYTFTSYYMYWVRQAPGQGLEWIGE
INPTSGETNFNEKFKSRATLTVDTSTSTAYLELSSLRSEDTAVYYCAREGGFA
YVVGQGTLVTVSSASTKGPSVFPLAPSSKSTSGGTAALGCLVKDYFPEPVTVS
WNSGALTSGVHTFPAVLQSSGLYSLSSVVTVPSSSLGTQTYICNVNHKPSNT
KVDKKVEPKS*CDKTHTSPPC* |
| SEQ ID NO: 475 | C' terminal-modified huAFD.v2.5 Heavy Chain | EVQLVQSGAEVKKPGASVKVSCKASGYTFTSYYMYWVRQAPGQGLEWIGE
INPYSGGTNFNEKFKSRATLTVDTSTSTAYLELSSLRSEDTAVYYCAREGGFA
YVVGQGTLVTVSSASTKGPSVFPLAPSSKSTSGGTAALGCLVKDYFPEPVTVS
WNSGALTSGVHTFPAVLQSSGLYSLSSVVTVPSSSLGTQTYICNVNHKPSNT
KVDKKVEPKS*CDKTHTSPPC* |
| SEQ ID NO: 476 | C' terminal-modified huAFD.v2.6 Heavy Chain | EVQLVQSGAEVKKPGASVKVSCKASGYTFTSYYMYWVRQAPGQGLEWIGE
INPTSGGTNFNEKFKSRATLTVDTSTSTAYLELSSLRSEDTAVYYCAREGGFA
YVVGQGTLVTVSSASTKGPSVFPLAPSSKSTSGGTAALGCLVKDYFPEPVTVS
WNSGALTSGVHTFPAVLQSSGLYSLSSVVTVPSSSLGTQTYICNVNHKPSNT
KVDKKVEPKS*CDKTHTSPPC* |
| SEQ ID NO: 477 | C' terminal-modified huAFD.v2.7 Heavy Chain | EVQLVQSGAEVKKPGASVKVSCKASGYTFTSYYMYWVRQAPGQGLEWIGE
INPTSGGTNFNEKFKSRATLTVDTSTSTAYLELSSLRSEDTAVYYCAREGGFA
YVVGQGTLVTVSSASTKGPSVFPLAPSSKSTSGGTAALGCLVKDYFPEPVTVS
WNSGALTSGVHTFPAVLQSSGLYSLSSVVTVPSSSLGTQTYICNVNHKPSNT
KVDKKVEPKS*CDKTHTSPPC* |
| SEQ ID NO: 478 | C' terminal-modified huAFD.v2.8 Heavy Chain | EVQLVQSGAEVKKPGASVKVSCKASGYTFTSYYMYWVRQAPGQGLEWIGE
INPTSGGTNFNEKFKSRATLTVDTSTSTAYLELSSLRSEDTAVYYCAREGGFA
YVVGQGTLVTVSSASTKGPSVFPLAPSSKSTSGGTAALGCLVKDYFPEPVTVS
WNSGALTSGVHTFPAVLQSSGLYSLSSVVTVPSSSLGTQTYICNVNHKPSNT
KVDKKVEPKS*CDKTHTSPPC* |
| SEQ ID NO: 479 | C' terminal-modified huAFD.v2.9 Heavy Chain | EVQLVQSGAEVKKPGASVKVSCKASGYTFTSYYMYWVRQAPGQGLEWIG
WINPTSGGTNFNEKFKSRATLTVDTSTSTAYLELSSLRSEDTAVYYCAREGG
FAYWGQGTLVTVSSASTKGPSVFPLAPSSKSTSGGTAALGCLVKDYFPEPVT
VSWNSGALTSGVHTFPAVLQSSGLYSLSSVVTVPSSSLGTQTYICNVNHKPS
NTKVDKKVEPKS*CDKTHTSPPC* |
| SEQ ID NO: 480 | C' terminal-modified huAFD.v2.10 Heavy Chain | EVQLVQSGAEVKKPGASVKVSCKASGYTFTSYYMYWVRQAPGQGLEWIGE
INPTSGGTNFNEKFKSRATLTVDTSTSTAYLELSSLRSEDTAVYYCAREGGFA
YVVGQGTLVTVSSASTKGPSVFPLAPSSKSTSGGTAALGCLVKDYFPEPVTVS
WNSGALTSGVHTFPAVLQSSGLYSLSSVVTVPSSSLGTQTYICNVNHKPSNT
KVDKKVEPKS*CDKTHTSPPC* |
| SEQ ID NO: 481 | C' terminal-modified huAFD.v2.11 Heavy Chain | EVQLVQSGAEVKKPGASVKVSCKASGYTFTSYYMYWVRQAPGQGLEWIGE
INPTSGGTNFNEKFKSRATLTVDTSTSTAYLELSSLRSEDTAVYYCAREGGFA
YVVGQGTLVTVSSASTKGPSVFPLAPSSKSTSGGTAALGCLVKDYFPEPVTVS
WNSGALTSGVHTFPAVLQSSGLYSLSSVVTVPSSSLGTQTYICNVNHKPSNT
KVDKKVEPKS*CDKTHTSPPC* |

TABLE 8-continued

Heavy chain and light chain amino acid sequences of C' terminal-modified anti-Factor D antibodies

| SEQ ID NO: 482 | C' terminal-modified huAFD.v2.12 Heavy Chain | EVQLVQSGAEVKKPGASVKVSCKASGYTFTSYYMYWVRQAPGQGLEWIGE INPYSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDKTHTSPPC* |
|---|---|---|
| SEQ ID NO: 483 | C' terminal-modified huAFD.v2.13 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDKTHTSPPC* |
| SEQ ID NO: 484 | C' terminal-modified huAFD.v2.14 Heavy Chain | EVQLVQSGAEVKKPGASVKVSCKASGYTFTSYYMYWVRQAPGQGLEWIGE INPTSGETNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDKTHTSPPC* |
| SEQ ID NO: 485 | C' terminal-modified huAFD.v2.15 Heavy Chain | EVQLVQSGAEVKKPGASVKVSCKASGYTFTSYYMYWVRQAPGQGLEWIGE INPYSGETNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDKTHTSPPC* |
| SEQ ID NO: 486 | C' terminal-modified AFD WT Heavy Chain | EVQLVQSGPELKKPGASVKVSCKASGYTFTNYGMNWVRQAPGQGLEWMG WINTYTGETTYADDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDKTHTAPPC* |
| SEQ ID NO: 487 | C' terminal-modified AFD.v1 Heavy Chain | EVQLVQSGPELKKPGASVKVSCKASGYTFTNYGMNWVRQAPGQGLEWMG WINTYTGETTYADDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDKTHTAPPC* |
| SEQ ID NO: 488 | C' terminal-modified AFD.v2 Heavy Chain | EVQLVQSGPELKKPGASVKVSCKASGYTFTNYGMNWVRQAPGQGLEWMG WINTYTGETTYADDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDKTHTAPPC* |
| SEQ ID NO: 489 | C' terminal-modified AFD.v3 Heavy Chain | EVQLVQSGPELKKPGASVKVSCKASGYTFTNYGMNWVRQAPGQGLEWMG WINTYTGETTYADDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDKTHTAPPC* |
| SEQ ID NO: 490 | C' terminal-modified AFD.v4 Heavy Chain | EVQLVQSGPELKKPGASVKVSCKASGYTFTNYGMNWVRQAPGQGLEWMG WINTYTGETTYADDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDKTHTAPPC* |
| SEQ ID NO: 491 | C' terminal-modified AFD.v5 Heavy Chain | EVQLVQSGPELKKPGASVKVSCKASGYTFTNYGMNWVRQAPGQGLEWMG WINTYTGETTYADDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDKTHTAPPC* |
| SEQ ID NO: 492 | C' terminal-modified AFD.v6 Heavy Chain | EVQLVQSGPELKKPGASVKVSCKASGYTFTNYGMNWVRQAPGQGLEWMG WINTYTGETTYAEDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDKTHTAPPC* |
| SEQ ID NO: 493 | C' terminal-modified AFD.v7 Heavy Chain | EVQLVQSGPELKKPGASVKVSCKASGYTFTNYGMNWVRQAPGQGLEWMG WINTYTGETTYAEDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDKTHTAPPC* |
| SEQ ID NO: 494 | C' terminal-modified AFD.v8 Heavy Chain | EVQLVQSGPELKKPGASVKVSCKASGYTFTNYGMNWVRQAPGQGLEWMG WINTYTGETTYAEDFKGRFVFSLDTSVSTAYLQISSLKAEDTAVYYCEREGG |

TABLE 8-continued

Heavy chain and light chain amino acid sequences of C' terminal-modified anti-Factor D antibodies

| SEQ ID NO: | | |
|---|---|---|
| | | VNNWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKS*CDKTHTAPPC* |
| SEQ ID NO: 495 | C' terminal-modified AFD.v9 Heavy Chain | EVQLVQSGPELKKPGASVKVSCKASGYTFTNYGMNWVRQAPGQGLEWMG<br>WINTYTGETTYAEDFKGRFVFSLDTSVSTAYLQISSLKAEDTAVYYCEREGG<br>VNNWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKS*CDKTHTAPPC* |
| SEQ ID NO: 496 | C' terminal-modified AFD.v10 Heavy Chain | EVQLVQSGPELKKPGASVKVSCKASGYTFTNYGMNWVRQAPGQGLEWMG<br>WINTYTGETTYAEDFKGRFVFSLDTSVSTAYLQISSLKAEDTAVYYCEREGG<br>VNNWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKS*CDKTHTAPPC* |
| SEQ ID NO: 497 | C' terminal-modified AFD.v11 Heavy Chain | EVQLVQSGPELKKPGASVKVSCKASGYTFTNYGMNWVRQAPGQGLEWMG<br>WISTYTGETTYAEDFKGRFVFSLDTSVSTAYLQISSLKAEDTAVYYCEREGG<br>VNNWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKS*CDKTHTAPPC* |
| SEQ ID NO: 498 | C' terminal-modified AFD.v12 Heavy Chain | EVQLVQSGPELKKPGASVKVSCKASGYTFTNYGMNWVRQAPGQGLEWMG<br>WINTYTGETTYAEDFKGRFVFSLDTSVSTAYLQISSLKAEDTAVYYCEREGG<br>VDNWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKS*CDKTHTAPPC* |
| SEQ ID NO: 499 | C' terminal-modified AFD.v13 Heavy Chain | EVQLVQSGPELKKPGASVKVSCKASGYTFTNYGMNWVRQAPGQGLEWMG<br>WINTYTGETTYAEDFKGRFVFSLDTSVSTAYLQISSLKAEDTAVYYCEREGG<br>VQNWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKS*CDKTHTAPPC* |
| SEQ ID NO: 500 | C' terminal-modified AFD.v14 Heavy Chain | EVQLVQSGPELKKPGASVKVSCKASGYTFTNYGMNWVRQAPGQGLEWMG<br>WINTYTGETTYAEDFKGRFVFSLDTSVSTAYLQISSLKAEDTAVYYCEREGG<br>VSNWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKS*CDKTHTAPPC* |
| SEQ ID NO: 501 | C' terminal-modified AFD.v15 Heavy Chain | EVQLVQSGPELKKPGASVKVSCKASGYTFTNYGMNWVRQAPGQGLEWMG<br>WINTYTGETTYAEDFKGRFVFSLDTSVSTAYLQISSLKAEDTAVYYCEREGG<br>VSNWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKS*CDKTHTAPPC* |
| SEQ ID NO: 502 | C' terminal-modified huAFD.v2.0 Heavy Chain | EVQLVQSGAEVKKPGASVKVSCKASGYTFTSYYMYWVRQAPGQGLEWIGE<br>INPTSGGTNFNEKFKSRATLTVDTSTSTAYLELSSLRSEDTAVYYCAREGGFA<br>YVVGQGTLVTVSSASTKGPSVFPLAPSSKSTSGGTAALGCLVKDYFPEPVTVS<br>WNSGALTSGVHTFPAVLQSSGLYSLSSVVTVPSSSLGTQTYICNVNHKPSNT<br>KVDKKVEPKS*CDKTHTAPPC* |
| SEQ ID NO: 503 | C' terminal-modified huAFD.v2.1 Heavy Chain | EVQLVQSGAEVKKPGASVKVSCKASGYTFTSYYMYWVRQAPGQGLEWIGE<br>INPTSGGTNFNEKFKSRATLTVDTSTSTAYLELSSLRSEDTAVYYCAREGGFA<br>YVVGQGTLVTVSSASTKGPSVFPLAPSSKSTSGGTAALGCLVKDYFPEPVTVS<br>WNSGALTSGVHTFPAVLQSSGLYSLSSVVTVPSSSLGTQTYICNVNHKPSNT<br>KVDKKVEPKS*CDKTHTAPPC* |
| SEQ ID NO: 504 | C' terminal-modified huAFD.v2.3 Heavy Chain | EVQLVQSGAEVKKPGASVKVSCKASGYTFTSYYMYWVRQAPGQGLEWIGE<br>INPYSGDTNFNEKFKSRATLTVDTSTSTAYLELSSLRSEDTAVYYCAREGGFA<br>YVVGQGTLVTVSSASTKGPSVFPLAPSSKSTSGGTAALGCLVKDYFPEPVTVS<br>WNSGALTSGVHTFPAVLQSSGLYSLSSVVTVPSSSLGTQTYICNVNHKPSNT<br>KVDKKVEPKS*CDKTHTAPPC* |
| SEQ ID NO: 505 | C' terminal-modified huAFD.v1 Heavy Chain | EVQLVQSGAEVKKPGASVKVSCKASGYTFTSYYMYWVRQAPGQGLEWIGE<br>INPTNGGTNFNEKFKSRATLTVDTSTSTAYLELSSLRSEDTAVYYCAREGGF<br>AYWGQGTLVTVSSASTKGPSVFPLAPSSKSTSGGTAALGCLVKDYFPEPVTV<br>SWNSGALTSGVHTFPAVLQSSGLYSLSSVVTVPSSSLGTQTYICNVNHKPSN<br>TKVDKKVEPKS*CDKTHTAPPC* |
| SEQ ID NO: 506 | C' terminal-modified huAFD.v1.1 Heavy Chain | EVQLVQSGAEVKKPGASVKVSCKASGYTFTSYYMYWVRQAPGQGLEWIGE<br>INPTQGGTNFNEKFKSRATLTVDTSTSTAYLELSSLRSEDTAVYYCAREGGF<br>AYWGQGTLVTVSSASTKGPSVFPLAPSSKSTSGGTAALGCLVKDYFPEPVTV<br>SWNSGALTSGVHTFPAVLQSSGLYSLSSVVTVPSSSLGTQTYICNVNHKPSN<br>TKVDKKVEPKS*CDKTHTAPPC* |

TABLE 8-continued

Heavy chain and light chain amino acid sequences of C' terminal-modified anti-Factor D antibodies

| SEQ ID NO: 507 | C' terminal-modified huAFD.v2.2 Heavy Chain | EVQLVQSGAEVKKPGASVKVSCKASGYTFTSYYMYWVRQAPGQGLEWIGE INPTSGDTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDKTHTAPPC* |
| --- | --- | --- |
| SEQ ID NO: 508 | C' terminal-modified huAFD.v2.4 Heavy Chain | EVQLVQSGAEVKKPGASVKVSCKASGYTFTSYYMYWVRQAPGQGLEWIGE INPTSGETNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDKTHTAPPC* |
| SEQ ID NO: 509 | C' terminal-modified huAFD.v2.5 Heavy Chain | EVQLVQSGAEVKKPGASVKVSCKASGYTFTSYYMYWVRQAPGQGLEWIGE INPYSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDKTHTAPPC* |
| SEQ ID NO: 510 | C' terminal-modified huAFD.v2.6 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDKTHTAPPC* |
| SEQ ID NO: 511 | C' terminal-modified huAFD.v2.7 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDKTHTAPPC* |
| SEQ ID NO: 512 | C' terminal-modified huAFD.v2.8 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDKTHTAPPC* |
| SEQ ID NO: 513 | C' terminal-modified huAFD.v2.9 Heavy Chain | EVQLVQSGAEVKKPGASVKVSCKASGYTFTSYYMYWVRQAPGQGLEWIG WINPTSGGTNFNEKFKSRATLTVDTSTSTAYLELSSLRSEDTAVYYCAREGG FAYWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDKTHTAPPC* |
| SEQ ID NO: 514 | C' terminal-modified huAFD.v2.10 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDKTHTAPPC* |
| SEQ ID NO: 515 | C' terminal-modified huAFD.v2.11 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDKTHTAPPC* |
| SEQ ID NO: 516 | C' terminal-modified huAFD.v2.12 Heavy Chain | EVQLVQSGAEVKKPGASVKVSCKASGYTFTSYYMYWVRQAPGQGLEWIGE INPYSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDKTHTAPPC* |
| SEQ ID NO: 517 | C' terminal-modified huAFD.v2.13 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDKTHTAPPC* |
| SEQ ID NO: 518 | C' terminal-modified huAFD.v2.14 Heavy Chain | EVQLVQSGAEVKKPGASVKVSCKASGYTFTSYYMYWVRQAPGQGLEWIGE INPTSGETNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDKTHTAPPC* |

TABLE 8-continued

Heavy chain and light chain amino acid sequences of C' terminal-modified anti-Factor D antibodies

| SEQ ID NO: 519 | C' terminal-modified huAFD.v2.15 Heavy Chain | EVQLVQSGAEVKKPGASVKVSCKASGYTFTSYYMYWVRQAPGQGLEWIGE INPYSGETNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDKTHTAPPC* |
|---|---|---|
| SEQ ID NO: 520 | C' terminal-modified AFD WT Heavy Chain | EVQLVQSGPELKKPGASVKVSCKASGYTFTNYGMNWVRQAPGQGLEWMG WINTYTGETTYADDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDKTHTSGGC* |
| SEQ ID NO: 521 | C' terminal-modified AFD.v1 Heavy Chain | EVQLVQSGPELKKPGASVKVSCKASGYTFTNYGMNWVRQAPGQGLEWMG WINTYTGETTYADDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDKTHTSGGC* |
| SEQ ID NO: 522 | C' terminal-modified AFD.v2 Heavy Chain | EVQLVQSGPELKKPGASVKVSCKASGYTFTNYGMNWVRQAPGQGLEWMG WINTYTGETTYADDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDKTHTSGGC* |
| SEQ ID NO: 523 | C' terminal-modified AFD.v3 Heavy Chain | EVQLVQSGPELKKPGASVKVSCKASGYTFTNYGMNWVRQAPGQGLEWMG WINTYTGETTYADDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDKTHTSGGC* |
| SEQ ID NO: 524 | C' terminal-modified AFD.v4 Heavy Chain | EVQLVQSGPELKKPGASVKVSCKASGYTFTNYGMNWVRQAPGQGLEWMG WINTYTGETTYADDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDKTHTSGGC* |
| SEQ ID NO: 525 | C' terminal-modified AFD.v5 Heavy Chain | EVQLVQSGPELKKPGASVKVSCKASGYTFTNYGMNWVRQAPGQGLEWMG WINTYTGETTYADDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDKTHTSGGC* |
| SEQ ID NO: 526 | C' terminal-modified AFD.v6 Heavy Chain | EVQLVQSGPELKKPGASVKVSCKASGYTFTNYGMNWVRQAPGQGLEWMG WINTYTGETTYAEDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDKTHTSGGC* |
| SEQ ID NO: 527 | C' terminal-modified AFD.v7 Heavy Chain | EVQLVQSGPELKKPGASVKVSCKASGYTFTNYGMNWVRQAPGQGLEWMG WINTYTGETTYAEDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDKTHTSGGC* |
| SEQ ID NO: 528 | C' terminal-modified AFD.v8 Heavy Chain | EVQLVQSGPELKKPGASVKVSCKASGYTFTNYGMNWVRQAPGQGLEWMG WINTYTGETTYAEDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDKTHTSGGC* |
| SEQ ID NO: 529 | C' terminal-modified AFD.v9 Heavy Chain | EVQLVQSGPELKKPGASVKVSCKASGYTFTNYGMNWVRQAPGQGLEWMG WINTYTGETTYAEDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDKTHTSGGC* |
| SEQ ID NO: 530 | C' terminal-modified AFD.v10 Heavy Chain | EVQLVQSGPELKKPGASVKVSCKASGYTFTNYGMNWVRQAPGQGLEWMG WINTYTGETTYAEDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDKTHTSGGC* |
| SEQ ID NO: 531 | C' terminal-modified AFD.v11 Heavy Chain | EVQLVQSGPELKKPGASVKVSCKASGYTFTNYGMNWVRQAPGQGLEWMG WISTYTGETTYAEDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDKTHTSGGC* |

TABLE 8-continued

Heavy chain and light chain amino acid sequences of C' terminal-modified anti-Factor D antibodies

| SEQ ID NO: 532 | C' terminal-modified AFD.v12 Heavy Chain | EVQLVQSGPELKKPGASVKVSCKASGYTFTNYGMNWVRQAPGQGLEWMG WINTYTGETTYAEDFKGRFVFSLDTSVSTAYLQISSLKAEDTAVYYCEREGG VDNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDKTHTSGGC* |
|---|---|---|
| SEQ ID NO: 533 | C' terminal-modified AFD.v13 Heavy Chain | EVQLVQSGPELKKPGASVKVSCKASGYTFTNYGMNWVRQAPGQGLEWMG WINTYTGETTYAEDFKGRFVFSLDTSVSTAYLQISSLKAEDTAVYYCEREGG VQNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDKTHTSGGC* |
| SEQ ID NO: 534 | C' terminal-modified AFD.v14 Heavy Chain | EVQLVQSGPELKKPGASVKVSCKASGYTFTNYGMNWVRQAPGQGLEWMG WINTYTGETTYAEDFKGRFVFSLDTSVSTAYLQISSLKAEDTAVYYCEREGG VSNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDKTHTSGGC* |
| SEQ ID NO: 535 | C' terminal-modified AFD.v15 Heavy Chain | EVQLVQSGPELKKPGASVKVSCKASGYTFTNYGMNWVRQAPGQGLEWMG WINTYTGETTYAEDFKGRFVFSLDTSVSTAYLQISSLKAEDTAVYYCEREGG VSNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDKTHTSGGC* |
| SEQ ID NO: 536 | C' terminal-modified huAFD.v2.0 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDKTHTSGGC* |
| SEQ ID NO: 537 | C' terminal-modified huAFD.v2.1 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDKTHTSGGC* |
| SEQ ID NO: 538 | C' terminal-modified huAFD.v2.3 Heavy Chain | EVQLVQSGAEVKKPGASVKVSCKASGYTFTSYYMYWVRQAPGQGLEWIGE INPYSGDTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS bWNSGALTSGVHTFPAVLQSSGLYSLSSVVTVPSSSLGTQTYICNVNHKPSNT KVDKKVEPKS*CDKTHTSGGC* |
| SEQ ID NO: 539 | C' terminal-modified huAFD.v1 Heavy Chain | EVQLVQSGAEVKKPGASVKVSCKASGYTFTSYYMYWVRQAPGQGLEWIGE INPTNGGTNFNEKFKSRATLTVDTSTSTAYLELSSLRSEDTAVYYCAREGGF AYWGQGTLVTVSSASTKGPSVFPLAPSSKSTSGGTAALGCLVKDYFPEPVTV SWNSGALTSGVHTFPAVLQSSGLYSLSSVVTVPSSSLGTQTYICNVNHKPSN TKVDKKVEPKS*CDKTHTSGGC* |
| SEQ ID NO: 540 | C' terminal-modified huAFD.v1.1 Heavy Chain | EVQLVQSGAEVKKPGASVKVSCKASGYTFTSYYMYWVRQAPGQGLEWIGE INPTQGGTNFNEKFKSRATLTVDTSTSTAYLELSSLRSEDTAVYYCAREGGF AYWGQGTLVTVSSASTKGPSVFPLAPSSKSTSGGTAALGCLVKDYFPEPVTV SWNSGALTSGVHTFPAVLQSSGLYSLSSVVTVPSSSLGTQTYICNVNHKPSN TKVDKKVEPKS*CDKTHTSGGC* |
| SEQ ID NO: 541 | C' terminal-modified huAFD.v2.2 Heavy Chain | EVQLVQSGAEVKKPGASVKVSCKASGYTFTSYYMYWVRQAPGQGLEWIGE INPTSGDTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDKTHTSGGC* |
| SEQ ID NO: 542 | C' terminal-modified huAFD.v2.4 Heavy Chain | EVQLVQSGAEVKKPGASVKVSCKASGYTFTSYYMYWVRQAPGQGLEWIGE INPTSGETNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDKTHTSGGC* |
| SEQ ID NO: 543 | C' terminal-modified huAFD.v2.5 Heavy Chain | EVQLVQSGAEVKKPGASVKVSCKASGYTFTSYYMYWVRQAPGQGLEWIGE INPYSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDKTHTSGGC* |

TABLE 8-continued

Heavy chain and light chain amino acid sequences of C' terminal-modified anti-Factor D antibodies

| SEQ ID NO: 544 | C' terminal-modified huAFD.v2.6 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDKTHTSGGC* |
|---|---|---|
| SEQ ID NO: 545 | C' terminal-modified huAFD.v2.7 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDKTHTSGGC* |
| SEQ ID NO: 546 | C' terminal-modified huAFD.v2.8 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDKTHTSGGC* |
| SEQ ID NO: 547 | C' terminal-modified huAFD.v2.9 Heavy Chain | EVQLVQSGAEVKKPGASVKVSCKASGYTFTSYYMYWVRQAPGQGLEWIG WINPTSGGTNFNEKFKSRATLTVDTSTSTAYLELSSLRSEDTAVYYCAREGG FAYWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDKTHTSGGC* |
| SEQ ID NO: 548 | C' terminal-modified huAFD.v2.10 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDKTHTSGGC* |
| SEQ ID NO: 549 | C' terminal-modified huAFD.v2.11 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDKTHTSGGC* |
| SEQ ID NO: 550 | C' terminal-modified huAFD.v2.12 Heavy Chain | EVQLVQSGAEVKKPGASVKVSCKASGYTFTSYYMYWVRQAPGQGLEWIGE INPYSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDKTHTSGGC* |
| SEQ ID NO: 551 | C' terminal-modified huAFD.v2.13 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDKTHTSGGC* |
| SEQ ID NO: 552 | C' terminal-modified huAFD.v2.14 Heavy Chain | EVQLVQSGAEVKKPGASVKVSCKASGYTFTSYYMYWVRQAPGQGLEWIGE INPTSGETNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDKTHTSGGC* |
| SEQ ID NO: 553 | C' terminal-modified huAFD.v2.15 Heavy Chain | EVQLVQSGAEVKKPGASVKVSCKASGYTFTSYYMYWVRQAPGQGLEWIGE INPYSGETNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDKTHTSGGC* |
| SEQ ID NO: 554 | C' terminal-modified AFD WT Heavy Chain | EVQLVQSGPELKKPGASVKVSCKASGYTFTNYGMNWVRQAPGQGLEWMG WINTYTGETTYADDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CYGPPC* |
| SEQ ID NO: 555 | C' terminal-modified AFD.v1 Heavy Chain | EVQLVQSGPELKKPGASVKVSCKASGYTFTNYGMNWVRQAPGQGLEWMG WINTYTGETTYADDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CYGPPC* |
| SEQ ID NO: 556 | C' terminal-modified AFD.v2 Heavy Chain | EVQLVQSGPELKKPGASVKVSCKASGYTFTNYGMNWVRQAPGQGLEWMG WINTYTGETTYADDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CYGPPC* |

TABLE 8-continued

Heavy chain and light chain amino acid sequences of C' terminal-modified anti-Factor D antibodies

| SEQ ID NO: 557 | C' terminal-modified AFD.v3 Heavy Chain | EVQLVQSGPELKKPGASVKVSCKASGYTFTNYGMNWVRQAPGQGLEWMG<br>WINTYTGETTYADDFKGRFVFSLDTSVSTAYLQISSLKAEDTAVYYCEREGG<br>VNNWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKS*CYGPPC* |
|---|---|---|
| SEQ ID NO: 558 | C' terminal-modified AFD.v4 Heavy Chain | EVQLVQSGPELKKPGASVKVSCKASGYTFTNYGMNWVRQAPGQGLEWMG<br>WINTYTGETTYADDFKGRFVFSLDTSVSTAYLQISSLKAEDTAVYYCEREGG<br>VNNWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKS*CYGPPC* |
| SEQ ID NO: 559 | C' terminal-modified AFD.v5 Heavy Chain | EVQLVQSGPELKKPGASVKVSCKASGYTFTNYGMNWVRQAPGQGLEWMG<br>WINTYTGETTYADDFKGRFVFSLDTSVSTAYLQISSLKAEDTAVYYCEREGG<br>VNNWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKS*CYGPPC* |
| SEQ ID NO: 560 | C' terminal-modified AFD.v6 Heavy Chain | EVQLVQSGPELKKPGASVKVSCKASGYTFTNYGMNWVRQAPGQGLEWMG<br>WINTYTGETTYAEDFKGRFVFSLDTSVSTAYLQISSLKAEDTAVYYCEREGG<br>VNNWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKS*CYGPPC* |
| SEQ ID NO: 561 | C' terminal-modified AFD.v7 Heavy Chain | EVQLVQSGPELKKPGASVKVSCKASGYTFTNYGMNWVRQAPGQGLEWMG<br>WINTYTGETTYAEDFKGRFVFSLDTSVSTAYLQISSLKAEDTAVYYCEREGG<br>VNNWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKS*CYGPPC* |
| SEQ ID NO: 562 | C' terminal-modified AFD.v8 Heavy Chain | EVQLVQSGPELKKPGASVKVSCKASGYTFTNYGMNWVRQAPGQGLEWMG<br>WINTYTGETTYAEDFKGRFVFSLDTSVSTAYLQISSLKAEDTAVYYCEREGG<br>VNNWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKS*CYGPPC* |
| SEQ ID NO: 563 | C' terminal-modified AFD.v9 Heavy Chain | EVQLVQSGPELKKPGASVKVSCKASGYTFTNYGMNWVRQAPGQGLEWMG<br>WINTYTGETTYAEDFKGRFVFSLDTSVSTAYLQISSLKAEDTAVYYCEREGG<br>VNNWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKS*CYGPPC* |
| SEQ ID NO: 564 | C' terminal-modified AFD.v10 Heavy Chain | EVQLVQSGPELKKPGASVKVSCKASGYTFTNYGMNWVRQAPGQGLEWMG<br>WINTYTGETTYAEDFKGRFVFSLDTSVSTAYLQISSLKAEDTAVYYCEREGG<br>VNNWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKS*CYGPPC* |
| SEQ ID NO: 565 | C' terminal-modified AFD.v11 Heavy Chain | EVQLVQSGPELKKPGASVKVSCKASGYTFTNYGMNWVRQAPGQGLEWMG<br>WISTYTGETTYAEDFKGRFVFSLDTSVSTAYLQISSLKAEDTAVYYCEREGG<br>VNNWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKS*CYGPPC* |
| SEQ ID NO: 566 | C' terminal-modified AFD.v12 Heavy Chain | EVQLVQSGPELKKPGASVKVSCKASGYTFTNYGMNWVRQAPGQGLEWMG<br>WINTYTGETTYAEDFKGRFVFSLDTSVSTAYLQISSLKAEDTAVYYCEREGG<br>VDNWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKS*CYGPPC* |
| SEQ ID NO: 567 | C' terminal-modified AFD.v13 Heavy Chain | EVQLVQSGPELKKPGASVKVSCKASGYTFTNYGMNWVRQAPGQGLEWMG<br>WINTYTGETTYAEDFKGRFVFSLDTSVSTAYLQISSLKAEDTAVYYCEREGG<br>VQNWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKS*CYGPPC* |
| SEQ ID NO: 568 | C' terminal-modified AFD.v14 Heavy Chain | EVQLVQSGPELKKPGASVKVSCKASGYTFTNYGMNWVRQAPGQGLEWMG<br>WINTYTGETTYAEDFKGRFVFSLDTSVSTAYLQISSLKAEDTAVYYCEREGG<br>VSNWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKS*CYGPPC* |
| SEQ ID NO: 569 | C' terminal-modified AFD.v15 Heavy Chain | EVQLVQSGPELKKPGASVKVSCKASGYTFTNYGMNWVRQAPGQGLEWMG<br>WINTYTGETTYAEDFKGRFVFSLDTSVSTAYLQISSLKAEDTAVYYCEREGG |

TABLE 8-continued

Heavy chain and light chain amino acid sequences of C' terminal-modified anti-Factor D antibodies

| | | |
|---|---|---|
| | | VSNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CYGPPC* |
| SEQ ID NO: 570 | C' terminal-modified huAFD.v2.0 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CYGPPC* |
| SEQ ID NO: 571 | C' terminal-modified huAFD.v2.1 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CYGPPC* |
| SEQ ID NO: 572 | C' terminal-modified huAFD.v2.3 Heavy Chain | EVQLVQSGAEVKKPGASVKVSCKASGYTFTSYYMYWVRQAPGQGLEWIGE INPYSGDTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CYGPPC* |
| SEQ ID NO: 573 | C' terminal-modified huAFD.v1 Heavy Chain | EVQLVQSGAEVKKPGASVKVSCKASGYTFTSYYMYWVRQAPGQGLEWIGE INPTNGGTNFNEKFKSRATLTVDTSTSTAYLELSSLRSEDTAVYYCAREGGF AYWGQGTLVTVSSASTKGPSVFPLAPSSKSTSGGTAALGCLVKDYFPEPVTV SWNSGALTSGVHTFPAVLQSSGLYSLSSVVTVPSSSLGTQTYICNVNHKPSN TKVDKKVEPKS*CYGPPC* |
| SEQ ID NO: 574 | C' terminal-modified huAFD.v1.1 Heavy Chain | EVQLVQSGAEVKKPGASVKVSCKASGYTFTSYYMYWVRQAPGQGLEWIGE INPTQGGTNFNEKFKSRATLTVDTSTSTAYLELSSLRSEDTAVYYCAREGGF AYWGQGTLVTVSSASTKGPSVFPLAPSSKSTSGGTAALGCLVKDYFPEPVTV SWNSGALTSGVHTFPAVLQSSGLYSLSSVVTVPSSSLGTQTYICNVNHKPSN TKVDKKVEPKS*CYGPPC* |
| SEQ ID NO: 575 | C' terminal-modified huAFD.v2.2 Heavy Chain | EVQLVQSGAEVKKPGASVKVSCKASGYTFTSYYMYWVRQAPGQGLEWIGE INPTSGDTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CYGPPC* |
| SEQ ID NO: 576 | C' terminal-modified huAFD.v2.4 Heavy Chain | EVQLVQSGAEVKKPGASVKVSCKASGYTFTSYYMYWVRQAPGQGLEWIGE INPTSGETNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CYGPPC* |
| SEQ ID NO: 577 | C' terminal-modified huAFD.v2.5 Heavy Chain | EVQLVQSGAEVKKPGASVKVSCKASGYTFTSYYMYWVRQAPGQGLEWIGE INPYSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CYGPPC* |
| SEQ ID NO: 578 | C' terminal-modified huAFD.v2.6 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CYGPPC* |
| SEQ ID NO: 579 | C' terminal-modified huAFD.v2.7 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CYGPPC* |
| SEQ ID NO: 580 | C' terminal-modified huAFD.v2.8 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CYGPPC* |
| SEQ ID NO: 581 | C' terminal-modified huAFD.v2.9 Heavy Chain | EVQLVQSGAEVKKPGASVKVSCKASGYTFTSYYMYWVRQAPGQGLEWIG WINPTSGGTNFNEKFKSRATLTVDTSTSTAYLELSSLRSEDTAVYYCAREGG FAYWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CYGPPC* |

TABLE 8-continued

Heavy chain and light chain amino acid sequences of C' terminal-modified anti-Factor D antibodies

| SEQ ID NO: 582 | C' terminal-modified huAFD.v2.10 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CYGPPC* |
|---|---|---|
| SEQ ID NO: 583 | C' terminal-modified huAFD.v2.11 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CYGPPC* |
| SEQ ID NO: 584 | C' terminal-modified huAFD.v2.12 Heavy Chain | EVQLVQSGAEVKKPGASVKVSCKASGYTFTSYYMYWVRQAPGQGLEWIGE INPYSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CYGPPC* |
| SEQ ID NO: 585 | C' terminal-modified huAFD.v2.13 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CYGPPC* |
| SEQ ID NO: 586 | C' terminal-modified huAFD.v2.14 Heavy Chain | EVQLVQSGAEVKKPGASVKVSCKASGYTFTSYYMYWVRQAPGQGLEWIGE INPTSGETNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CYGPPC* |
| SEQ ID NO: 587 | C' terminal-modified huAFD.v2.15 Heavy Chain | EVQLVQSGAEVKKPGASVKVSCKASGYTFTSYYMYWVRQAPGQGLEWIGE INPYSGETNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CYGPPC* |
| SEQ ID NO: 588 | C' terminal-modified AFD WT Heavy Chain | EVQLVQSGPELKKPGASVKVSCKASGYTFTNYGMNWVRQAPGQGLEWMG WINTYTGETTYADDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*VERK* |
| SEQ ID NO: 589 | C' terminal-modified AFD.v1 Heavy Chain | EVQLVQSGPELKKPGASVKVSCKASGYTFTNYGMNWVRQAPGQGLEWMG WINTYTGETTYADDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*VERK* |
| SEQ ID NO: 590 | C' terminal-modified AFD.v2 Heavy Chain | EVQLVQSGPELKKPGASVKVSCKASGYTFTNYGMNWVRQAPGQGLEWMG WINTYTGETTYADDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*VERK* |
| SEQ ID NO: 591 | C' terminal-modified AFD.v3 Heavy Chain | EVQLVQSGPELKKPGASVKVSCKASGYTFTNYGMNWVRQAPGQGLEWMG WINTYTGETTYADDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*VERK* |
| SEQ ID NO: 592 | C' terminal-modified AFD.v4 Heavy Chain | EVQLVQSGPELKKPGASVKVSCKASGYTFTNYGMNWVRQAPGQGLEWMG WINTYTGETTYADDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*VERK* |
| SEQ ID NO: 593 | C' terminal-modified AFD.v5 Heavy Chain | EVQLVQSGPELKKPGASVKVSCKASGYTFTNYGMNWVRQAPGQGLEWMG WINTYTGETTYADDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*VERK* |
| SEQ ID NO: 594 | C' terminal-modified AFD.v6 Heavy Chain | EVQLVQSGPELKKPGASVKVSCKASGYTFTNYGMNWVRQAPGQGLEWMG WINTYTGETTYAEDFKGRFVFSLDTSVSTAYLQISSLKAEDTAVYYCEREGG |

TABLE 8-continued

Heavy chain and light chain amino acid sequences of C' terminal-modified anti-Factor D antibodies

| | | |
|---|---|---|
| | | SASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKS*VERK* |
| SEQ ID<br>NO: 595 | C' terminal-modified<br>AFD.v7 Heavy Chain | EVQLVQSGPELKKPGASVKVSCKASGYTFTNYGMNWVRQAPGQGLEWMG<br>WINTYTGETTYAEDFKGRFVFSLDTSVSTAYLQISSLKAEDTAVYYCEREGG<br>VNNWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKS*VERK* |
| SEQ ID<br>NO: 596 | C' terminal-modified<br>AFD.v8 Heavy Chain | EVQLVQSGPELKKPGASVKVSCKASGYTFTNYGMNWVRQAPGQGLEWMG<br>WINTYTGETTYAEDFKGRFVFSLDTSVSTAYLQISSLKAEDTAVYYCEREGG<br>VNNWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKS*VERK* |
| SEQ ID<br>NO: 597 | C' terminal-modified<br>AFD.v9 Heavy Chain | EVQLVQSGPELKKPGASVKVSCKASGYTFTNYGMNWVRQAPGQGLEWMG<br>WINTYTGETTYAEDFKGRFVFSLDTSVSTAYLQISSLKAEDTAVYYCEREGG<br>SASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKS*VERK* |
| SEQ ID<br>NO: 598 | C' terminal-modified<br>AFD.v10 Heavy Chain | EVQLVQSGPELKKPGASVKVSCKASGYTFTNYGMNWVRQAPGQGLEWMG<br>WINTYTGETTYAEDFKGRFVFSLDTSVSTAYLQISSLKAEDTAVYYCEREGG<br>VNNWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKS*VERK* |
| SEQ ID<br>NO: 599 | C' terminal-modified<br>AFD.v11 Heavy Chain | EVQLVQSGPELKKPGASVKVSCKASGYTFTNYGMNWVRQAPGQGLEWMG<br>WISTYTGETTYAEDFKGRFVFSLDTSVSTAYLQISSLKAEDTAVYYCEREGG<br>VNNWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKS*VERK* |
| SEQ ID<br>NO: 600 | C' terminal-modified<br>AFD.v12 Heavy Chain | EVQLVQSGPELKKPGASVKVSCKASGYTFTNYGMNWVRQAPGQGLEWMG<br>WINTYTGETTYAEDFKGRFVFSLDTSVSTAYLQISSLKAEDTAVYYCEREGG<br>VDNWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKS*VERK* |
| SEQ ID<br>NO: 601 | C' terminal-modified<br>AFD.v13 Heavy Chain | EVQLVQSGPELKKPGASVKVSCKASGYTFTNYGMNWVRQAPGQGLEWMG<br>WINTYTGETTYAEDFKGRFVFSLDTSVSTAYLQISSLKAEDTAVYYCEREGG<br>VQNWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKS*VERK* |
| SEQ ID<br>NO: 602 | C' terminal-modified<br>AFD.v14 Heavy Chain | EVQLVQSGPELKKPGASVKVSCKASGYTFTNYGMNWVRQAPGQGLEWMG<br>WINTYTGETTYAEDFKGRFVFSLDTSVSTAYLQISSLKAEDTAVYYCEREGG<br>VSNWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKS*VERK* |
| SEQ ID<br>NO: 603 | C' terminal-modified<br>AFD.v15 Heavy Chain | EVQLVQSGPELKKPGASVKVSCKASGYTFTNYGMNWVRQAPGQGLEWMG<br>WINTYTGETTYAEDFKGRFVFSLDTSVSTAYLQISSLKAEDTAVYYCEREGG<br>VSNWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKS*VERK* |
| SEQ ID<br>NO: 604 | C' terminal-modified<br>huAFD.v2.0 Heavy<br>Chain | EVQLVQSGAEVKKPGASVKVSCKASGYTFTSYYMYWVRQAPGQGLEWIGE<br>INPTSGGTNFNEKFKSRATLTVDTSTSTAYLELSSLRSEDTAVYYCAREGGFA<br>YVVGQGTLVTVSSASTKGPSVFPLAPSSKSTSGGTAALGCLVKDYFPEPVTVS<br>WNSGALTSGVHTFPAVLQSSGLYSLSSVVTVPSSSLGTQTYICNVNHKPSNT<br>KVDKKVEPKS*VERK* |
| SEQ ID<br>NO: 605 | C' terminal-modified<br>huAFD.v2.1 Heavy<br>Chain | EVQLVQSGAEVKKPGASVKVSCKASGYTFTSYYMYWVRQAPGQGLEWIGE<br>INPTSGGTNFNEKFKSRATLTVDTSTSTAYLELSSLRSEDTAVYYCAREGGFA<br>YVVGQGTLVTVSSASTKGPSVFPLAPSSKSTSGGTAALGCLVKDYFPEPVTVS<br>WNSGALTSGVHTFPAVLQSSGLYSLSSVVTVPSSSLGTQTYICNVNHKPSNT<br>KVDKKVEPKS*VERK* |
| SEQ ID<br>NO: 606 | C' terminal-modified<br>huAFD.v2.3 Heavy<br>Chain | EVQLVQSGAEVKKPGASVKVSCKASGYTFTSYYMYWVRQAPGQGLEWIGE<br>INPYSGDTNFNEKFKSRATLTVDTSTSTAYLELSSLRSEDTAVYYCAREGGFA<br>YVVGQGTLVTVSSASTKGPSVFPLAPSSKSTSGGTAALGCLVKDYFPEPVTVS<br>WNSGALTSGVHTFPAVLQSSGLYSLSSVVTVPSSSLGTQTYICNVNHKPSNT<br>KVDKKVEPKS*VERK* |

TABLE 8-continued

Heavy chain and light chain amino acid sequences of C' terminal-modified anti-Factor D antibodies

| SEQ ID NO: 607 | C' terminal-modified huAFD.v1 Heavy Chain | EVQLVQSGAEVKKPGASVKVSCKASGYTFTSYYMYWVRQAPGQGLEWIGE INPTNGGTNFNEKFKSRATLTVDTSTSTAYLELSSLRSEDTAVYYCAREGGF AYWGQGTLVTVSSASTKGPSVFPLAPSSKSTSGGTAALGCLVKDYFPEPVTV SWNSGALTSGVHTFPAVLQSSGLYSLSSVVTVPSSSLGTQTYICNVNHKPSN TKVDKKVEPKS*VERK* |
|---|---|---|
| SEQ ID NO: 608 | C' terminal-modified huAFD.v1.1 Heavy Chain | EVQLVQSGAEVKKPGASVKVSCKASGYTFTSYYMYWVRQAPGQGLEWIGE INPTQGGTNFNEKFKSRATLTVDTSTSTAYLELSSLRSEDTAVYYCAREGGF AYWGQGTLVTVSSASTKGPSVFPLAPSSKSTSGGTAALGCLVKDYFPEPVTV SWNSGALTSGVHTFPAVLQSSGLYSLSSVVTVPSSSLGTQTYICNVNHKPSN TKVDKKVEPKS*VERK* |
| SEQ ID NO: 609 | C' terminal-modified huAFD.v2.2 Heavy Chain | EVQLVQSGAEVKKPGASVKVSCKASGYTFTSYYMYWVRQAPGQGLEWIGE INPTSGDTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*VERK* |
| SEQ ID NO: 610 | C' terminal-modified huAFD.v2.4 Heavy Chain | EVQLVQSGAEVKKPGASVKVSCKASGYTFTSYYMYWVRQAPGQGLEWIGE INPTSGETNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*VERK* |
| SEQ ID NO: 611 | C' terminal-modified huAFD.v2.5 Heavy Chain | EVQLVQSGAEVKKPGASVKVSCKASGYTFTSYYMYWVRQAPGQGLEWIGE INPYSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*VERK* |
| SEQ ID NO: 612 | C' terminal-modified huAFD.v2.6 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*VERK* |
| SEQ ID NO: 613 | C' terminal-modified huAFD.v2.7 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*VERK* |
| SEQ ID NO: 614 | C' terminal-modified huAFD.v2.8 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*VERK* |
| SEQ ID NO: 615 | C' terminal-modified huAFD.v2.9 Heavy Chain | EVQLVQSGAEVKKPGASVKVSCKASGYTFTSYYMYWVRQAPGQGLEWIG WINPTSGGTNFNEKFKSRATLTVDTSTSTAYLELSSLRSEDTAVYYCAREGG FAYWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*VERK* |
| SEQ ID NO: 616 | C' terminal-modified huAFD.v2.10 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*VERK* |
| SEQ ID NO: 617 | C' terminal-modified huAFD.v2.11 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*VERK* |
| SEQ ID NO: 618 | C' terminal-modified huAFD.v2.12 Heavy Chain | EVQLVQSGAEVKKPGASVKVSCKASGYTFTSYYMYWVRQAPGQGLEWIGE INPYSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*VERK* |

TABLE 8-continued

Heavy chain and light chain amino acid sequences of C' terminal-modified anti-Factor D antibodies

| SEQ ID NO: 619 | C' terminal-modified huAFD.v2.13 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*VERK* |
|---|---|---|
| SEQ ID NO: 620 | C' terminal-modified huAFD.v2.14 Heavy Chain | EVQLVQSGAEVKKPGASVKVSCKASGYTFTSYYMYWVRQAPGQGLEWIGE INPTSGETNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*VERK* |
| SEQ ID NO: 621 | C' terminal-modified huAFD.v2.15 Heavy Chain | EVQLVQSGAEVKKPGASVKVSCKASGYTFTSYYMYWVRQAPGQGLEWIGE INPYSGETNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*VERK* |
| SEQ ID NO: 622 | C' terminal-modified AFD WT Heavy Chain | EVQLVQSGPELKKPGASVKVSCKASGYTFTNYGMNWVRQAPGQGLEWMG WINTYTGETTYADDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*VERKC* |
| SEQ ID NO: 623 | C' terminal-modified AFD.v1 Heavy Chain | EVQLVQSGPELKKPGASVKVSCKASGYTFTNYGMNWVRQAPGQGLEWMG WINTYTGETTYADDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*VERKC* |
| SEQ ID NO: 624 | C' terminal-modified AFD.v2 Heavy Chain | EVQLVQSGPELKKPGASVKVSCKASGYTFTNYGMNWVRQAPGQGLEWMG WINTYTGETTYADDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*VERKC* |
| SEQ ID NO: 625 | C' terminal-modified AFD.v3 Heavy Chain | EVQLVQSGPELKKPGASVKVSCKASGYTFTNYGMNWVRQAPGQGLEWMG WINTYTGETTYADDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*VERKC* |
| SEQ ID NO: 626 | C' terminal-modified AFD.v4 Heavy Chain | EVQLVQSGPELKKPGASVKVSCKASGYTFTNYGMNWVRQAPGQGLEWMG WINTYTGETTYADDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*VERKC* |
| SEQ ID NO: 627 | C' terminal-modified AFD.v5 Heavy Chain | EVQLVQSGPELKKPGASVKVSCKASGYTFTNYGMNWVRQAPGQGLEWMG WINTYTGETTYADDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*VERKC* |
| SEQ ID NO: 628 | C' terminal-modified AFD.v6 Heavy Chain | EVQLVQSGPELKKPGASVKVSCKASGYTFTNYGMNWVRQAPGQGLEWMG WINTYTGETTYAEDFKGRFVFSLDTSVSTAYLQISSLKAEDTAVYYCEREGG SASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*VERKC* |
| SEQ ID NO: 629 | C' terminal-modified AFD.v7 Heavy Chain | EVQLVQSGPELKKPGASVKVSCKASGYTFTNYGMNWVRQAPGQGLEWMG WINTYTGETTYAEDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*VERKC* |
| SEQ ID NO: 630 | C' terminal-modified AFD.v8 Heavy Chain | EVQLVQSGPELKKPGASVKVSCKASGYTFTNYGMNWVRQAPGQGLEWMG WINTYTGETTYAEDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*VERKC* |
| SEQ ID NO: 631 | C' terminal-modified AFD.v9 Heavy Chain | EVQLVQSGPELKKPGASVKVSCKASGYTFTNYGMNWVRQAPGQGLEWMG WINTYTGETTYAEDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*VERKC* |

TABLE 8-continued

Heavy chain and light chain amino acid sequences of C' terminal-modified anti-Factor D antibodies

| SEQ ID NO: 632 | C' terminal-modified AFD.v10 Heavy Chain | EVQLVQSGPELKKPGASVKVSCKASGYTFTNYGMNWVRQAPGQGLEWMG WINTYTGETTYAEDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*VERKC* |
|---|---|---|
| SEQ ID NO: 633 | C' terminal-modified AFD.v11 Heavy Chain | EVQLVQSGPELKKPGASVKVSCKASGYTFTNYGMNWVRQAPGQGLEWMG WISTYTGETTYAEDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*VERKC* |
| SEQ ID NO: 634 | C' terminal-modified AFD.v12 Heavy Chain | EVQLVQSGPELKKPGASVKVSCKASGYTFTNYGMNWVRQAPGQGLEWMG WINTYTGETTYAEDFKGRFVFSLDTSVSTAYLQISSLKAEDTAVYYCEREGG VDNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*VERKC* |
| SEQ ID NO: 635 | C' terminal-modified AFD.v13 Heavy Chain | EVQLVQSGPELKKPGASVKVSCKASGYTFTNYGMNWVRQAPGQGLEWMG WINTYTGETTYAEDFKGRFVFSLDTSVSTAYLQISSLKAEDTAVYYCEREGG VQNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*VERKC* |
| SEQ ID NO: 636 | C' terminal-modified AFD.v14 Heavy Chain | EVQLVQSGPELKKPGASVKVSCKASGYTFTNYGMNWVRQAPGQGLEWMG WINTYTGETTYAEDFKGRFVFSLDTSVSTAYLQISSLKAEDTAVYYCEREGG VSNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*VERKC* |
| SEQ ID NO: 637 | C' terminal-modified AFD.v15 Heavy Chain | EVQLVQSGPELKKPGASVKVSCKASGYTFTNYGMNWVRQAPGQGLEWMG WINTYTGETTYAEDFKGRFVFSLDTSVSTAYLQISSLKAEDTAVYYCEREGG VSNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*VERKC* |
| SEQ ID NO: 638 | C' terminal-modified huAFDv2.0 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*VERKC* |
| SEQ ID NO: 639 | C' terminal-modified huAFD.v2.1 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*VERKC* |
| SEQ ID NO: 640 | C' terminal-modified huAFD.v2.3 Heavy Chain | EVQLVQSGAEVKKPGASVKVSCKASGYTFTSYYMYWVRQAPGQGLEWIGE INPYSGDTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*VERKC* |
| SEQ ID NO: 641 | C' terminal-modified huAFD.v1 Heavy Chain | EVQLVQSGAEVKKPGASVKVSCKASGYTFTSYYMYWVRQAPGQGLEWIGE INPTNGGTNFNEKFKSRATLTVDTSTSTAYLELSSLRSEDTAVYYCAREGGF AYWGQGTLVTVSSASTKGPSVFPLAPSSKSTSGGTAALGCLVKDYFPEPVTV SWNSGALTSGVHTFPAVLQSSGLYSLSSVVTVPSSSLGTQTYICNVNHKPSN TKVDKKVEPKS*VERKC* |
| SEQ ID NO: 642 | C' terminal-modified huAFD.v1.1 Heavy Chain | EVQLVQSGAEVKKPGASVKVSCKASGYTFTSYYMYWVRQAPGQGLEWIGE INPTQGGTNFNEKFKSRATLTVDTSTSTAYLELSSLRSEDTAVYYCAREGGF AYWGQGTLVTVSSASTKGPSVFPLAPSSKSTSGGTAALGCLVKDYFPEPVTV SWNSGALTSGVHTFPAVLQSSGLYSLSSVVTVPSSSLGTQTYICNVNHKPSN TKVDKKVEPKS*VERKC* |
| SEQ ID NO: 643 | C' terminal-modified huAFD.v2.2 Heavy Chain | EVQLVQSGAEVKKPGASVKVSCKASGYTFTSYYMYWVRQAPGQGLEWIGE INPTSGDTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*VERKC* |

TABLE 8-continued

Heavy chain and light chain amino acid sequences of C' terminal-modified anti-Factor D antibodies

| SEQ ID NO: 644 | C' terminal-modified huAFD.v2.4 Heavy Chain | EVQLVQSGAEVKKPGASVKVSCKASGYTFTSYYMYWVRQAPGQGLEWIGE INPTSGETNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*VERKC* |
|---|---|---|
| SEQ ID NO: 645 | C' terminal-modified huAFD.v2.5 Heavy Chain | EVQLVQSGAEVKKPGASVKVSCKASGYTFTSYYMYWVRQAPGQGLEWIGE INPYSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*VERKC* |
| SEQ ID NO: 646 | C' terminal-modified huAFD.v2.6 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*VERKC* |
| SEQ ID NO: 647 | C' terminal-modified huAFD.v2.7 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*VERKC* |
| SEQ ID NO: 648 | C' terminal-modified huAFD.v2.8 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*VERKC* |
| SEQ ID NO: 649 | C' terminal-modified huAFD.v2.9 Heavy Chain | EVQLVQSGAEVKKPGASVKVSCKASGYTFTSYYMYWVRQAPGQGLEWIG WINPTSGGTNFNEKFKSRATLTVDTSTSTAYLELSSLRSEDTAVYYCAREGG FAYWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*VERKC* |
| SEQ ID NO: 650 | C' terminal-modified huAFD.v2.10 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*VERKC* |
| SEQ ID NO: 651 | C' terminal-modified huAFD.v2.11 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*VERKC* |
| SEQ ID NO: 652 | C' terminal-modified huAFD.v2.12 Heavy Chain | EVQLVQSGAEVKKPGASVKVSCKASGYTFTSYYMYWVRQAPGQGLEWIGE INPYSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*VERKC* |
| SEQ ID NO: 653 | C' terminal-modified huAFD.v2.13 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*VERKC* |
| SEQ ID NO: 654 | C' terminal-modified huAFD.v2.14 Heavy Chain | EVQLVQSGAEVKKPGASVKVSCKASGYTFTSYYMYWVRQAPGQGLEWIGE INPTSGETNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*VERKC* |
| SEQ ID NO: 655 | C' terminal-modified huAFD.v2.15 Heavy Chain | EVQLVQSGAEVKKPGASVKVSCKASGYTFTSYYMYWVRQAPGQGLEWIGE INPYSGETNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*VERKC* |
| SEQ ID NO: 656 | C' terminal-modified AFD WT Heavy Chain | EVQLVQSGPELKKPGASVKVSCKASGYTFTNYGMNWVRQAPGQGLEWMG WINTYTGETTYADDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*KYGPPC* |

TABLE 8-continued

Heavy chain and light chain amino acid sequences of C' terminal-modified anti-Factor D antibodies

| SEQ ID NO: 657 | C' terminal-modified AFD.v1 Heavy Chain | EVQLVQSGPELKKPGASVKVSCKASGYTFTNYGMNWVRQAPGQGLEWMG WINTYTGETTYADDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*KYGPPC* |
| --- | --- | --- |
| SEQ ID NO: 658 | C' terminal-modified AFD.v2 Heavy Chain | EVQLVQSGPELKKPGASVKVSCKASGYTFTNYGMNWVRQAPGQGLEWMG WINTYTGETTYADDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*KYGPPC* |
| SEQ ID NO: 659 | C' terminal-modified AFD.v3 Heavy Chain | EVQLVQSGPELKKPGASVKVSCKASGYTFTNYGMNWVRQAPGQGLEWMG WINTYTGETTYADDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*KYGPPC* |
| SEQ ID NO: 660 | C' terminal-modified AFD.v4 Heavy Chain | EVQLVQSGPELKKPGASVKVSCKASGYTFTNYGMNWVRQAPGQGLEWMG WINTYTGETTYADDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*KYGPPC* |
| SEQ ID NO: 661 | C' terminal-modified AFD.v5 Heavy Chain | EVQLVQSGPELKKPGASVKVSCKASGYTFTNYGMNWVRQAPGQGLEWMG WINTYTGETTYADDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*KYGPPC* |
| SEQ ID NO: 662 | C' terminal-modified AFD.v6 Heavy Chain | EVQLVQSGPELKKPGASVKVSCKASGYTFTNYGMNWVRQAPGQGLEWMG WINTYTGETTYAEDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*KYGPPC* |
| SEQ ID NO: 663 | C' terminal-modified AFD.v7 Heavy Chain | EVQLVQSGPELKKPGASVKVSCKASGYTFTNYGMNWVRQAPGQGLEWMG WINTYTGETTYAEDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*KYGPPC* |
| SEQ ID NO: 664 | C' terminal-modified AFD.v8 Heavy Chain | EVQLVQSGPELKKPGASVKVSCKASGYTFTNYGMNWVRQAPGQGLEWMG WINTYTGETTYAEDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*KYGPPC* |
| SEQ ID NO: 665 | C' terminal-modified AFD.v9 Heavy Chain | EVQLVQSGPELKKPGASVKVSCKASGYTFTNYGMNWVRQAPGQGLEWMG WINTYTGETTYAEDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*KYGPPC* |
| SEQ ID NO: 666 | C' terminal-modified AFD.v10 Heavy Chain | EVQLVQSGPELKKPGASVKVSCKASGYTFTNYGMNWVRQAPGQGLEWMG WINTYTGETTYAEDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*KYGPPC* |
| SEQ ID NO: 667 | C' terminal-modified AFD.v11 Heavy Chain | EVQLVQSGPELKKPGASVKVSCKASGYTFTNYGMNWVRQAPGQGLEWMG WISTYTGETTYAEDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*KYGPPC* |
| SEQ ID NO: 668 | C' terminal-modified AFD.v12 Heavy Chain | EVQLVQSGPELKKPGASVKVSCKASGYTFTNYGMNWVRQAPGQGLEWMG WINTYTGETTYAEDFKGRFVFSLDTSVSTAYLQISSLKAEDTAVYYCEREGG VDNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*KYGPPC* |
| SEQ ID NO: 669 | C' terminal-modified AFD.v13 Heavy Chain | EVQLVQSGPELKKPGASVKVSCKASGYTFTNYGMNWVRQAPGQGLEWMG WINTYTGETTYAEDFKGRFVFSLDTSVSTAYLQISSLKAEDTAVYYCEREGG VQNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*KYGPPC* |

TABLE 8-continued

Heavy chain and light chain amino acid sequences of C' terminal-modified anti-Factor D antibodies

| SEQ ID NO: 670 | C' terminal-modified AFD.v14 Heavy Chain | EVQLVQSGPELKKPGASVKVSCKASGYTFTNYGMNWVRQAPGQGLEWMG WINTYTGETTYAEDFKGRFVFSLDTSVSTAYLQISSLKAEDTAVYYCEREGG VSNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*KYGPPC* |
|---|---|---|
| SEQ ID NO: 671 | C' terminal-modified AFD.v15 Heavy Chain | EVQLVQSGPELKKPGASVKVSCKASGYTFTNYGMNWVRQAPGQGLEWMG WINTYTGETTYAEDFKGRFVFSLDTSVSTAYLQISSLKAEDTAVYYCEREGG VSNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*KYGPPC* |
| SEQ ID NO: 672 | C' terminal-modified huAFD.v2.0 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*KYGPPC* |
| SEQ ID NO: 673 | C' terminal-modified huAFD.v2.1 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*KYGPPC* |
| SEQ ID NO: 674 | C' terminal-modified huAFD.v2.3 Heavy Chain | EVQLVQSGAEVKKPGASVKVSCKASGYTFTSYYMYWVRQAPGQGLEWIGE INPYSGDTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*KYGPPC* |
| SEQ ID NO: 675 | C' terminal-modified huAFD.v1 Heavy Chain | EVQLVQSGAEVKKPGASVKVSCKASGYTFTSYYMYWVRQAPGQGLEWIGE INPTNGGTNFNEKFKSRATLTVDTSTSTAYLELSSLRSEDTAVYYCAREGGF AYWGQGTLVTVSSASTKGPSVFPLAPSSKSTSGGTAALGCLVKDYFPEPVTV SWNSGALTSGVHTFPAVLQSSGLYSLSSVVTVPSSSLGTQTYICNVNHKPSN TKVDKKVEPKS*KYGPPC* |
| SEQ ID NO: 676 | C' terminal-modified huAFD.v1.1 Heavy Chain | EVQLVQSGAEVKKPGASVKVSCKASGYTFTSYYMYWVRQAPGQGLEWIGE INPTQGGTNFNEKFKSRATLTVDTSTSTAYLELSSLRSEDTAVYYCAREGGF AYWGQGTLVTVSSASTKGPSVFPLAPSSKSTSGGTAALGCLVKDYFPEPVTV SWNSGALTSGVHTFPAVLQSSGLYSLSSVVTVPSSSLGTQTYICNVNHKPSN TKVDKKVEPKS*KYGPPC* |
| SEQ ID NO: 677 | C' terminal-modified huAFD.v2.2 Heavy Chain | EVQLVQSGAEVKKPGASVKVSCKASGYTFTSYYMYWVRQAPGQGLEWIGE INPTSGDTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*KYGPPC* |
| SEQ ID NO: 678 | C' terminal-modified huAFD.v2.4 Heavy Chain | EVQLVQSGAEVKKPGASVKVSCKASGYTFTSYYMYWVRQAPGQGLEWIGE INPTSGETNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*KYGPPC* |
| SEQ ID NO: 679 | C' terminal-modified huAFD.v2.5 Heavy Chain | EVQLVQSGAEVKKPGASVKVSCKASGYTFTSYYMYWVRQAPGQGLEWIGE INPYSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*KYGPPC* |
| SEQ ID NO: 680 | C' terminal-modified huAFD.v2.6 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*KYGPPC* |
| SEQ ID NO: 681 | C' terminal-modified huAFD.v2.7 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*KYGPPC* |
| SEQ ID NO: 682 | C' terminal-modified huAFD.v2.8 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*KYGPPC* |

TABLE 8-continued

Heavy chain and light chain amino acid sequences of C' terminal-modified anti-Factor D antibodies

| SEQ ID NO: 683 | C' terminal-modified huAFD.v2.9 Heavy Chain | EVQLVQSGAEVKKPGASVKVSCKASGYTFTSYYMYWVRQAPGQGLEWIG WINPTSGGTNFNEKFKSRATLTVDTSTSTAYLELSSLRSEDTAVYYCAREGG FAYWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*KYGPPC* |
|---|---|---|
| SEQ ID NO: 684 | C' terminal-modified huAFD.v2.10 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*KYGPPC* |
| SEQ ID NO: 685 | C' terminal-modified huAFD.v2.11 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*KYGPPC* |
| SEQ ID NO: 686 | C' terminal-modified huAFD.v2.12 Heavy Chain | EVQLVQSGAEVKKPGASVKVSCKASGYTFTSYYMYWVRQAPGQGLEWIGE INPYSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*KYGPPC* |
| SEQ ID NO: 687 | C' terminal-modified huAFD.v2.13 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*KYGPPC* |
| SEQ ID NO: 688 | C' terminal-modified huAFD.v2.14 Heavy Chain | EVQLVQSGAEVKKPGASVKVSCKASGYTFTSYYMYWVRQAPGQGLEWIGE INPTSGETNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*KYGPPC* |
| SEQ ID NO: 689 | C' terminal-modified huAFD.v2.15 Heavy Chain | EVQLVQSGAEVKKPGASVKVSCKASGYTFTSYYMYWVRQAPGQGLEWIGE INPYSGETNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*KYGPPC* |
| SEQ ID NO: 690 | C' terminal-modified FD WT Heavy Chain | AEVQLVQSGPELKKPGASVKVSCKASGYTFTNYGMNWVRQAPGQGLEWMG WINTYTGETTYADDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*KYGPP* |
| SEQ ID NO: 691 | C' terminal-modified AFD.v1 Heavy Chain | EVQLVQSGPELKKPGASVKVSCKASGYTFTNYGMNWVRQAPGQGLEWMG WINTYTGETTYADDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*KYGPP* |
| SEQ ID NO: 692 | C' terminal-modified AFD.v2 Heavy Chain | EVQLVQSGPELKKPGASVKVSCKASGYTFTNYGMNWVRQAPGQGLEWMG WINTYTGETTYADDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*KYGPP* |
| SEQ ID NO: 693 | C' terminal-modified AFD.v3 Heavy Chain | EVQLVQSGPELKKPGASVKVSCKASGYTFTNYGMNWVRQAPGQGLEWMG WINTYTGETTYADDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*KYGPP* |
| SEQ ID NO: 694 | C' terminal-modified AFD.v4 Heavy Chain | EVQLVQSGPELKKPGASVKVSCKASGYTFTNYGMNWVRQAPGQGLEWMG WINTYTGETTYADDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*KYGPP* |
| SEQ ID NO: 695 | C' terminal-modified AFD.v5 Heavy Chain | EVQLVQSGPELKKPGASVKVSCKASGYTFTNYGMNWVRQAPGQGLEWMG WINTYTGETTYADDFKGRFVFSLDTSVSTAYLQISSLKAEDTAVYYCEREGG |

TABLE 8-continued

Heavy chain and light chain amino acid sequences of C' terminal-modified anti-Factor D antibodies

|  |  |  |
|---|---|---|
| | | VNNWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKS*KYGPP* |
| SEQ ID<br>NO: 696 | C' terminal-modified<br>AFD.v6 Heavy Chain | EVQLVQSGPELKKPGASVKVSCKASGYTFTNYGMNWVRQAPGQGLEWMG<br>WINTYTGETTYAEDFKGRFVFSLDTSVSTAYLQISSLKAEDTAVYYCEREGG<br>VNNWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKS*KYGPP* |
| SEQ ID<br>NO: 697 | C' terminal-modified<br>AFD.v7 Heavy Chain | EVQLVQSGPELKKPGASVKVSCKASGYTFTNYGMNWVRQAPGQGLEWMG<br>WINTYTGETTYAEDFKGRFVFSLDTSVSTAYLQISSLKAEDTAVYYCEREGG<br>VNNWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKS*KYGPP* |
| SEQ ID<br>NO: 698 | C' terminal-modified<br>AFD.v8 Heavy Chain | EVQLVQSGPELKKPGASVKVSCKASGYTFTNYGMNWVRQAPGQGLEWMG<br>WINTYTGETTYAEDFKGRFVFSLDTSVSTAYLQISSLKAEDTAVYYCEREGG<br>SASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKS*KYGPP* |
| SEQ ID<br>NO: 699 | C' terminal-modified<br>AFD.v9 Heavy Chain | EVQLVQSGPELKKPGASVKVSCKASGYTFTNYGMNWVRQAPGQGLEWMG<br>WINTYTGETTYAEDFKGRFVFSLDTSVSTAYLQISSLKAEDTAVYYCEREGG<br>VNNWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKS*KYGPP* |
| SEQ ID<br>NO: 700 | C' terminal-modified<br>AFD.v10 Heavy Chain | EVQLVQSGPELKKPGASVKVSCKASGYTFTNYGMNWVRQAPGQGLEWMG<br>WINTYTGETTYAEDFKGRFVFSLDTSVSTAYLQISSLKAEDTAVYYCEREGG<br>VNNWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKS*KYGPP* |
| SEQ ID<br>NO: 701 | C' terminal-modified<br>AFD.v11 Heavy Chain | EVQLVQSGPELKKPGASVKVSCKASGYTFTNYGMNWVRQAPGQGLEWMG<br>WISTYTGETTYAEDFKGRFVFSLDTSVSTAYLQISSLKAEDTAVYYCEREGG<br>VNNWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKS*KYGPP* |
| SEQ ID<br>NO: 702 | C' terminal-modified<br>AFD.v12 Heavy Chain | EVQLVQSGPELKKPGASVKVSCKASGYTFTNYGMNWVRQAPGQGLEWMG<br>WINTYTGETTYAEDFKGRFVFSLDTSVSTAYLQISSLKAEDTAVYYCEREGG<br>VDNWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKS*KYGPP* |
| SEQ ID<br>NO: 703 | C' terminal-modified<br>AFD.v13 Heavy Chain | EVQLVQSGPELKKPGASVKVSCKASGYTFTNYGMNWVRQAPGQGLEWMG<br>WINTYTGETTYAEDFKGRFVFSLDTSVSTAYLQISSLKAEDTAVYYCEREGG<br>VQNWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKS*KYGPP* |
| SEQ ID<br>NO: 704 | C' terminal-modified<br>AFD.v14 Heavy Chain | EVQLVQSGPELKKPGASVKVSCKASGYTFTNYGMNWVRQAPGQGLEWMG<br>WINTYTGETTYAEDFKGRFVFSLDTSVSTAYLQISSLKAEDTAVYYCEREGG<br>VSNWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKS*KYGPP* |
| SEQ ID<br>NO: 705 | C' terminal-modified<br>AFD.v15 Heavy Chain | EVQLVQSGPELKKPGASVKVSCKASGYTFTNYGMNWVRQAPGQGLEWMG<br>WINTYTGETTYAEDFKGRFVFSLDTSVSTAYLQISSLKAEDTAVYYCEREGG<br>VSNWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKS*KYGPP* |
| SEQ ID<br>NO: 706 | C' terminal-modified<br>huAFD.v2.0 Heavy<br>Chain | EVQLVQSGAEVKKPGASVKVSCKASGYTFTSYYMYWVRQAPGQGLEWIGE<br>INPTSGGTNFNEKFKSRATLTVDTSTSTAYLELSSLRSEDTAVYYCAREGGFA<br>YVVGQGTLVTVSSASTKGPSVFPLAPSSKSTSGGTAALGCLVKDYFPEPVTVS<br>WNSGALTSGVHTFPAVLQSSGLYSLSSVVTVPSSSLGTQTYICNVNHKPSNT<br>KVDKKVEPKS*KYGPP* |
| SEQ ID<br>NO: 707 | C' terminal-modified<br>huAFD.v2.1 Heavy<br>Chain | EVQLVQSGAEVKKPGASVKVSCKASGYTFTSYYMYWVRQAPGQGLEWIGE<br>INPTSGGTNFNEKFKSRATLTVDTSTSTAYLELSSLRSEDTAVYYCAREGGFA<br>YVVGQGTLVTVSSASTKGPSVFPLAPSSKSTSGGTAALGCLVKDYFPEPVTVS<br>WNSGALTSGVHTFPAVLQSSGLYSLSSVVTVPSSSLGTQTYICNVNHKPSNT<br>KVDKKVEPKS*KYGPP* |

TABLE 8-continued

Heavy chain and light chain amino acid sequences of C' terminal-modified anti-Factor D antibodies

| SEQ ID NO: 708 | C' terminal-modified huAFD.v2.3 Heavy Chain | EVQLVQSGAEVKKPGASVKVSCKASGYTFTSYYMYWVRQAPGQGLEWIGE INPYSGDTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKSKYGPP |
|---|---|---|
| SEQ ID NO: 709 | C' terminal-modified huAFD.v1 Heavy Chain | EVQLVQSGAEVKKPGASVKVSCKASGYTFTSYYMYWVRQAPGQGLEWIGE INPTNGGTNFNEKFKSRATLTVDTSTSTAYLELSSLRSEDTAVYYCAREGGF AYWGQGTLVTVSSASTKGPSVFPLAPSSKSTSGGTAALGCLVKDYFPEPVTV SWNSGALTSGVHTFPAVLQSSGLYSLSSVVTVPSSSLGTQTYICNVNHKPSN TKVDKKVEPKSKYGPP |
| SEQ ID NO: 710 | C' terminal-modified huAFD.v1.1 Heavy Chain | EVQLVQSGAEVKKPGASVKVSCKASGYTFTSYYMYWVRQAPGQGLEWIGE INPTQGGTNFNEKFKSRATLTVDTSTSTAYLELSSLRSEDTAVYYCAREGGF AYWGQGTLVTVSSASTKGPSVFPLAPSSKSTSGGTAALGCLVKDYFPEPVTV SWNSGALTSGVHTFPAVLQSSGLYSLSSVVTVPSSSLGTQTYICNVNHKPSN TKVDKKVEPKSKYGPP |
| SEQ ID NO: 711 | C' terminal-modified huAFD.v2.2 Heavy Chain | EVQLVQSGAEVKKPGASVKVSCKASGYTFTSYYMYWVRQAPGQGLEWIGE INPTSGDTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKSKYGPP |
| SEQ ID NO: 712 | C' terminal-modified huAFD.v2.4 Heavy Chain | EVQLVQSGAEVKKPGASVKVSCKASGYTFTSYYMYWVRQAPGQGLEWIGE INPTSGETNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKSKYGPP |
| SEQ ID NO: 713 | C' terminal-modified huAFD.v2.5 Heavy Chain | EVQLVQSGAEVKKPGASVKVSCKASGYTFTSYYMYWVRQAPGQGLEWIGE INPYSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKSKYGPP |
| SEQ ID NO: 714 | C' terminal-modified huAFD.v2.6 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKSKYGPP |
| SEQ ID NO: 715 | C' terminal-modified huAFD.v2.7 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKSKYGPP |
| SEQ ID NO: 716 | C' terminal-modified huAFD.v2.8 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKSKYGPP |
| SEQ ID NO: 717 | C' terminal-modified huAFD.v2.9 Heavy Chain | EVQLVQSGAEVKKPGASVKVSCKASGYTFTSYYMYWVRQAPGQGLEWIG WINPTSGGTNFNEKFKSRATLTVDTSTSTAYLELSSLRSEDTAVYYCAREGG FAYWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKSKYGPP |
| SEQ ID NO: 718 | C' terminal-modified huAFD.v2.10 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKSKYGPP |
| SEQ ID NO: 719 | C' terminal-modified huAFD.v2.11 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKSKYGPP |

TABLE 8-continued

Heavy chain and light chain amino acid sequences of C' terminal-modified anti-Factor D antibodies

| SEQ ID NO: 720 | C' terminal-modified huAFD.v2.12 Heavy Chain | EVQLVQSGAEVKKPGASVKVSCKASGYTFTSYYMYWVRQAPGQGLEWIGE INPYSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*KYGPP* |
| --- | --- | --- |
| SEQ ID NO: 721 | C' terminal-modified huAFD.v2.13 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*KYGPP* |
| SEQ ID NO: 722 | C' terminal-modified huAFD.v2.14 Heavy Chain | EVQLVQSGAEVKKPGASVKVSCKASGYTFTSYYMYWVRQAPGQGLEWIGE INPTSGETNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*KYGPP* |
| SEQ ID NO: 723 | C' terminal-modified huAFD.v2.15 Heavy Chain | EVQLVQSGAEVKKPGASVKVSCKASGYTFTSYYMYWVRQAPGQGLEWIGE INPYSGETNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*KYGPP* |
| SEQ ID NO: 724 | C' terminal-modified AFD WT Heavy Chain | EVQLVQSGPELKKPGASVKVSCKASGYTFTNYGMNWVRQAPGQGLEWMG WINTYTGETTYADDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*KYGP* |
| SEQ ID NO: 725 | C' terminal-modified AFD.v1 Heavy Chain | EVQLVQSGPELKKPGASVKVSCKASGYTFTNYGMNWVRQAPGQGLEWMG WINTYTGETTYADDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*KYG* |
| SEQ ID NO: 726 | C' terminal-modified AFD.v2 Heavy Chain | EVQLVQSGPELKKPGASVKVSCKASGYTFTNYGMNWVRQAPGQGLEWMG WINTYTGETTYADDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*KYGP* |
| SEQ ID NO: 727 | C' terminal-modified AFD.v3 Heavy Chain | EVQLVQSGPELKKPGASVKVSCKASGYTFTNYGMNWVRQAPGQGLEWMG WINTYTGETTYADDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*KYG* |
| SEQ ID NO: 728 | C' terminal-modified AFD.v4 Heavy Chain | EVQLVQSGPELKKPGASVKVSCKASGYTFTNYGMNWVRQAPGQGLEWMG WINTYTGETTYADDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*KYGP* |
| SEQ ID NO: 729 | C' terminal-modified AFD.v5 Heavy Chain | EVQLVQSGPELKKPGASVKVSCKASGYTFTNYGMNWVRQAPGQGLEWMG WINTYTGETTYADDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*KYG* |
| SEQ ID NO: 730 | C' terminal-modified AFD.v6 Heavy Chain | EVQLVQSGPELKKPGASVKVSCKASGYTFTNYGMNWVRQAPGQGLEWMG WINTYTGETTYAEDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*KYGP* |
| SEQ ID NO: 731 | C' terminal-modified AFD.v7 Heavy Chain | EVQLVQSGPELKKPGASVKVSCKASGYTFTNYGMNWVRQAPGQGLEWMG WINTYTGETTYAEDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*KYG* |
| SEQ ID NO: 732 | C' terminal-modified AFD.v8 Heavy Chain | EVQLVQSGPELKKPGASVKVSCKASGYTFTNYGMNWVRQAPGQGLEWMG WINTYTGETTYAEDFKGRFVFSLDTSVSTAYLQISSLKAEDTAVYYCEREGG |

TABLE 8-continued

Heavy chain and light chain amino acid sequences of C' terminal-modified anti-Factor D antibodies

| | | |
|---|---|---|
| | | VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*KYGP* |
| SEQ ID NO: 733 | C' terminal-modified AFD.v9 Heavy Chain | EVQLVQSGPELKKPGASVKVSCKASGYTFTNYGMNWVRQAPGQGLEWMG WINTYTGETTYAEDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*KYGP* |
| SEQ ID NO: 734 | C' terminal-modified AFD.v10 Heavy Chain | EVQLVQSGPELKKPGASVKVSCKASGYTFTNYGMNWVRQAPGQGLEWMG WINTYTGETTYAEDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*KYGP* |
| SEQ ID NO: 735 | C' terminal-modified AFD.v11 Heavy Chain | EVQLVQSGPELKKPGASVKVSCKASGYTFTNYGMNWVRQAPGQGLEWMG WISTYTGETTYAEDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*KYGP* |
| SEQ ID NO: 736 | C' terminal-modified AFD.v12 Heavy Chain | EVQLVQSGPELKKPGASVKVSCKASGYTFTNYGMNWVRQAPGQGLEWMG WINTYTGETTYAEDFKGRFVFSLDTSVSTAYLQISSLKAEDTAVYYCEREGG VDNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*KYGP* |
| SEQ ID NO: 737 | C' terminal-modified AFD.v13 Heavy Chain | EVQLVQSGPELKKPGASVKVSCKASGYTFTNYGMNWVRQAPGQGLEWMG WINTYTGETTYAEDFKGRFVFSLDTSVSTAYLQISSLKAEDTAVYYCEREGG VQNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*KYGP* |
| SEQ ID NO: 738 | C' terminal-modified AFD.v14 Heavy Chain | EVQLVQSGPELKKPGASVKVSCKASGYTFTNYGMNWVRQAPGQGLEWMG WINTYTGETTYAEDFKGRFVFSLDTSVSTAYLQISSLKAEDTAVYYCEREGG VSNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*KYGP* |
| SEQ ID NO: 739 | C' terminal-modified AFD.v15 Heavy Chain | EVQLVQSGPELKKPGASVKVSCKASGYTFTNYGMNWVRQAPGQGLEWMG WINTYTGETTYAEDFKGRFVFSLDTSVSTAYLQISSLKAEDTAVYYCEREGG VSNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*KYGP* |
| SEQ ID NO: 740 | C' terminal-modified huAFD.v2.0 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*KYGP* |
| SEQ ID NO: 741 | C' terminal-modified huAFD.v2.1 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*KYGP* |
| SEQ ID NO: 742 | C' terminal-modified huAFD.v2.3 Heavy Chain | EVQLVQSGAEVKKPGASVKVSCKASGYTFTSYYMYWVRQAPGQGLEWIGE INPYSGDTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*KYGP* |
| SEQ ID NO: 743 | C' terminal-modified huAFD.v1 Heavy Chain | EVQLVQSGAEVKKPGASVKVSCKASGYTFTSYYMYWVRQAPGQGLEWIGE INPTNGGTNFNEKFKSRATLTVDTSTSTAYLELSSLRSEDTAVYYCAREGGF AYWGQGTLVTVSSASTKGPSVFPLAPSSKSTSGGTAALGCLVKDYFPEPVTV SWNSGALTSGVHTFPAVLQSSGLYSLSSVVTVPSSSLGTQTYICNVNHKPSN TKVDKKVEPKS*KYGP* |
| SEQ ID NO: 744 | C' terminal-modified huAFD.v1.1 Heavy Chain | EVQLVQSGAEVKKPGASVKVSCKASGYTFTSYYMYWVRQAPGQGLEWIGE INPTQGGTNFNEKFKSRATLTVDTSTSTAYLELSSLRSEDTAVYYCAREGGF AYWGQGTLVTVSSASTKGPSVFPLAPSSKSTSGGTAALGCLVKDYFPEPVTV SWNSGALTSGVHTFPAVLQSSGLYSLSSVVTVPSSSLGTQTYICNVNHKPSN TKVDKKVEPKS*KYGP* |

TABLE 8-continued

Heavy chain and light chain amino acid sequences of C' terminal-modified anti-Factor D antibodies

| SEQ ID NO: 745 | C' terminal-modified huAFD.v2.2 Heavy Chain | EVQLVQSGAEVKKPGASVKVSCKASGYTFTSYYMYWVRQAPGQGLEWIGE INPTSGDTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*KYGP* |
| --- | --- | --- |
| SEQ ID NO: 746 | C' terminal-modified huAFD.v2.4 Heavy Chain | EVQLVQSGAEVKKPGASVKVSCKASGYTFTSYYMYWVRQAPGQGLEWIGE INPTSGETNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*KYGP* |
| SEQ ID NO: 747 | C' terminal-modified huAFD.v2.5 Heavy Chain | EVQLVQSGAEVKKPGASVKVSCKASGYTFTSYYMYWVRQAPGQGLEWIGE INPYSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*KYGP* |
| SEQ ID NO: 748 | C' terminal-modified huAFD.v2.6 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*KYGP* |
| SEQ ID NO: 749 | C' terminal-modified huAFD.v2.7 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*KYGP* |
| SEQ ID NO: 750 | C' terminal-modified huAFD.v2.8 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*KYGP* |
| SEQ ID NO: 751 | C' terminal-modified huAFD.v2.9 Heavy Chain | EVQLVQSGAEVKKPGASVKVSCKASGYTFTSYYMYWVRQAPGQGLEWIG WINPTSGGTNFNEKFKSRATLTVDTSTSTAYLELSSLRSEDTAVYYCAREGG FAYWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*KYGP* |
| SEQ ID NO: 752 | C' terminal-modified huAFD.v2.10 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*KYGP* |
| SEQ ID NO: 753 | C' terminal-modified huAFD.v2.11 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*KYGP* |
| SEQ ID NO: 754 | C' terminal-modified huAFD.v2.12 Heavy Chain | EVQLVQSGAEVKKPGASVKVSCKASGYTFTSYYMYWVRQAPGQGLEWIGE INPYSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*KYGP* |
| SEQ ID NO: 755 | C' terminal-modified huAFD.v2.13 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*KYGP* |
| SEQ ID NO: 756 | C' terminal-modified huAFD.v2.14 Heavy Chain | EVQLVQSGAEVKKPGASVKVSCKASGYTFTSYYMYWVRQAPGQGLEWIGE INPTSGETNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*KYGP* |

TABLE 8-continued

Heavy chain and light chain amino acid sequences of C' terminal-modified anti-Factor D antibodies

| SEQ ID NO: 757 | C' terminal-modified huAFD.v2.15 Heavy Chain | EVQLVQSGAEVKKPGASVKVSCKASGYTFTSYYMYWVRQAPGQGLEWIGE INPYSGETNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*KYGP* |
|---|---|---|
| SEQ ID NO: 758 | C' terminal-modified AFD WT Heavy Chain | EVQLVQSGPELKKPGASVKVSCKASGYTFTNYGMNWVRQAPGQGLEWMG WINTYTGETTYADDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*KYG* |
| SEQ ID NO: 759 | C' terminal-modified AFD.v1 Heavy Chain | EVQLVQSGPELKKPGASVKVSCKASGYTFTNYGMNWVRQAPGQGLEWMG WINTYTGETTYADDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*KYG* |
| SEQ ID NO: 760 | C' terminal-modified AFD.v2 Heavy Chain | EVQLVQSGPELKKPGASVKVSCKASGYTFTNYGMNWVRQAPGQGLEWMG WINTYTGETTYADDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*KYG* |
| SEQ ID NO: 761 | C' terminal-modified AFD.v3 Heavy Chain | EVQLVQSGPELKKPGASVKVSCKASGYTFTNYGMNWVRQAPGQGLEWMG WINTYTGETTYADDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*KYG* |
| SEQ ID NO: 762 | C' terminal-modified AFD.v4 Heavy Chain | EVQLVQSGPELKKPGASVKVSCKASGYTFTNYGMNWVRQAPGQGLEWMG WINTYTGETTYADDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*KYG* |
| SEQ ID NO: 763 | C' terminal-modified AFD.v5 Heavy Chain | EVQLVQSGPELKKPGASVKVSCKASGYTFTNYGMNWVRQAPGQGLEWMG WINTYTGETTYADDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*KYG* |
| SEQ ID NO: 764 | C' terminal-modified AFD.v6 Heavy Chain | EVQLVQSGPELKKPGASVKVSCKASGYTFTNYGMNWVRQAPGQGLEWMG WINTYTGETTYAEDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*KYG* |
| SEQ ID NO: 765 | C' terminal-modified AFD.v7 Heavy Chain | EVQLVQSGPELKKPGASVKVSCKASGYTFTNYGMNWVRQAPGQGLEWMG WINTYTGETTYAEDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*KYG* |
| SEQ ID NO: 766 | C' terminal-modified AFD.v8 Heavy Chain | EVQLVQSGPELKKPGASVKVSCKASGYTFTNYGMNWVRQAPGQGLEWMG WINTYTGETTYAEDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*KYG* |
| SEQ ID NO: 767 | C' terminal-modified AFD.v9 Heavy Chain | EVQLVQSGPELKKPGASVKVSCKASGYTFTNYGMNWVRQAPGQGLEWMG WINTYTGETTYAEDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*KYG* |
| SEQ ID NO: 768 | C' terminal-modified AFD.v10 Heavy Chain | EVQLVQSGPELKKPGASVKVSCKASGYTFTNYGMNWVRQAPGQGLEWMG WINTYTGETTYAEDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*KYG* |

TABLE 8-continued

Heavy chain and light chain amino acid sequences of C' terminal-modified anti-Factor D antibodies

| SEQ ID NO: 769 | C' terminal-modified AFD.v11 Heavy Chain | EVQLVQSGPELKKPGASVKVSCKASGYTFTNYGMNWVRQAPGQGLEWMG WISTYTGETTYAEDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKSKYG |
| --- | --- | --- |
| SEQ ID NO: 770 | C' terminal-modified AFD.v12 Heavy Chain | EVQLVQSGPELKKPGASVKVSCKASGYTFTNYGMNWVRQAPGQGLEWMG WINTYTGETTYAEDFKGRFVFSLDTSVSTAYLQISSLKAEDTAVYYCEREGG SASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKSKYG |
| SEQ ID NO: 771 | C' terminal-modified AFD.v13 Heavy Chain | EVQLVQSGPELKKPGASVKVSCKASGYTFTNYGMNWVRQAPGQGLEWMG WINTYTGETTYAEDFKGRFVFSLDTSVSTAYLQISSLKAEDTAVYYCEREGG VQNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKSKYG |
| SEQ ID NO: 772 | C' terminal-modified AFD.v14 Heavy Chain | EVQLVQSGPELKKPGASVKVSCKASGYTFTNYGMNWVRQAPGQGLEWMG WINTYTGETTYAEDFKGRFVFSLDTSVSTAYLQISSLKAEDTAVYYCEREGG VSNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKSKYG |
| SEQ ID NO: 773 | C' terminal-modified AFD.v15 Heavy Chain | EVQLVQSGPELKKPGASVKVSCKASGYTFTNYGMNWVRQAPGQGLEWMG WINTYTGETTYAEDFKGRFVFSLDTSVSTAYLQISSLKAEDTAVYYCEREGG VSNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKSKYG |
| SEQ ID NO: 774 | C' terminal-modified huAFD.v2.0 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKSKYG |
| SEQ ID NO: 775 | C' terminal-modified huAFD.v2.1 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKSKYG |
| SEQ ID NO: 776 | C' terminal-modified huAFD.v2.3 Heavy Chain | EVQLVQSGAEVKKPGASVKVSCKASGYTFTSYYMYWVRQAPGQGLEWIGE INPYSGDTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKSKYG |
| SEQ ID NO: 777 | C' terminal-modified huAFD.v1 Heavy Chain | EVQLVQSGAEVKKPGASVKVSCKASGYTFTSYYMYWVRQAPGQGLEWIGE INPTNGGTNFNEKFKSRATLTVDTSTSTAYLELSSLRSEDTAVYYCAREGGF AYWGQGTLVTVSSASTKGPSVFPLAPSSKSTSGGTAALGCLVKDYFPEPVTV SWNSGALTSGVHTFPAVLQSSGLYSLSSVVTVPSSSLGTQTYICNVNHKPSN TKVDKKVEPKSKYG |
| SEQ ID NO: 778 | C' terminal-modified huAFD.v1.1 Heavy Chain | EVQLVQSGAEVKKPGASVKVSCKASGYTFTSYYMYWVRQAPGQGLEWIGE INPTQGGTNFNEKFKSRATLTVDTSTSTAYLELSSLRSEDTAVYYCAREGGF AYWGQGTLVTVSSASTKGPSVFPLAPSSKSTSGGTAALGCLVKDYFPEPVTV SWNSGALTSGVHTFPAVLQSSGLYSLSSVVTVPSSSLGTQTYICNVNHKPSN TKVDKKVEPKSKYG |
| SEQ ID NO: 779 | C' terminal-modified huAFD.v2.2 Heavy Chain | EVQLVQSGAEVKKPGASVKVSCKASGYTFTSYYMYWVRQAPGQGLEWIGE INPTSGDTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKSKYG |
| SEQ ID NO: 780 | C' terminal-modified huAFD.v2.4 Heavy Chain | EVQLVQSGAEVKKPGASVKVSCKASGYTFTSYYMYWVRQAPGQGLEWIGE INPTSGETNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKSKYG |

TABLE 8-continued

Heavy chain and light chain amino acid sequences of C' terminal-modified anti-Factor D antibodies

| SEQ ID NO: 781 | C' terminal-modified huAFD.v2.5 Heavy Chain | EVQLVQSGAEVKKPGASVKVSCKASGYTFTSYYMYWVRQAPGQGLEWIGE INPYSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*KYG* |
| --- | --- | --- |
| SEQ ID NO: 782 | C' terminal-modified huAFD.v2.6 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*KYG* |
| SEQ ID NO: 783 | C' terminal-modified huAFD.v2.7 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*KYG* |
| SEQ ID NO: 784 | C' terminal-modified huAFD.v2.8 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*KYG* |
| SEQ ID NO: 785 | C' terminal-modified huAFD.v2.9 Heavy Chain | EVQLVQSGAEVKKPGASVKVSCKASGYTFTSYYMYWVRQAPGQGLEWIG WINPTSGGTNFNEKFKSRATLTVDTSTSTAYLELSSLRSEDTAVYYCAREGG FAYWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*KYG* |
| SEQ ID NO: 786 | C' terminal-modified huAFD.v2.10 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*KYG* |
| SEQ ID NO: 787 | C' terminal-modified huAFD.v2.11 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*KYG* |
| SEQ ID NO: 788 | C' terminal-modified huAFD.v2.12 Heavy Chain | EVQLVQSGAEVKKPGASVKVSCKASGYTFTSYYMYWVRQAPGQGLEWIGE INPYSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*KYG* |
| SEQ ID NO: 789 | C' terminal-modified huAFD.v2.13 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*KYG* |
| SEQ ID NO: 790 | C' terminal-modified huAFD.v2.14 Heavy Chain | EVQLVQSGAEVKKPGASVKVSCKASGYTFTSYYMYWVRQAPGQGLEWIGE INPTSGETNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*KYG* |
| SEQ ID NO: 791 | C' terminal-modified huAFD.v2.15 Heavy Chain | EVQLVQSGAEVKKPGASVKVSCKASGYTFTSYYMYWVRQAPGQGLEWIGE INPYSGETNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*KYG* |
| SEQ ID NO: 792 | C' terminal-modified AFD WT Heavy Chain | EVQLVQSGPELKKPGASVKVSCKASGYTFTNYGMNWVRQAPGQGLEWMG WINTYTGETTYADDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*KY* |

TABLE 8-continued

Heavy chain and light chain amino acid sequences of C' terminal-modified anti-Factor D antibodies

| | | |
|---|---|---|
| SEQ ID NO: 793 | C' terminal-modified AFD.v1 Heavy Chain | EVQLVQSGPELKKPGASVKVSCKASGYTFTNYGMNWVRQAPGQGLEWMG WINTYTGETTYADDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKSKY |
| SEQ ID NO: 794 | C' terminal-modified AFD.v2 Heavy Chain | EVQLVQSGPELKKPGASVKVSCKASGYTFTNYGMNWVRQAPGQGLEWMG WINTYTGETTYADDFKGRFVFSLDTSVSTAYLQISSLKAEDTAVYYCEREGG SASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKSKY |
| SEQ ID NO: 795 | C' terminal-modified AFD.v3 Heavy Chain | EVQLVQSGPELKKPGASVKVSCKASGYTFTNYGMNWVRQAPGQGLEWMG WINTYTGETTYADDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKSKY |
| SEQ ID NO: 796 | C' terminal-modified AFD.v4 Heavy Chain | EVQLVQSGPELKKPGASVKVSCKASGYTFTNYGMNWVRQAPGQGLEWMG WINTYTGETTYADDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKSKY |
| SEQ ID NO: 797 | C' terminal-modified AFD.v5 Heavy Chain | EVQLVQSGPELKKPGASVKVSCKASGYTFTNYGMNWVRQAPGQGLEWMG WINTYTGETTYADDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKSKY |
| SEQ ID NO: 798 | C' terminal-modified AFD.v6 Heavy Chain | EVQLVQSGPELKKPGASVKVSCKASGYTFTNYGMNWVRQAPGQGLEWMG WINTYTGETTYAEDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKSKY |
| SEQ ID NO: 799 | C' terminal-modified AFD.v7 Heavy Chain | EVQLVQSGPELKKPGASVKVSCKASGYTFTNYGMNWVRQAPGQGLEWMG WINTYTGETTYAEDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKSKY |
| SEQ ID NO: 800 | C' terminal-modified AFD.v8 Heavy Chain | EVQLVQSGPELKKPGASVKVSCKASGYTFTNYGMNWVRQAPGQGLEWMG WINTYTGETTYAEDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKSKY |
| SEQ ID NO: 801 | C' terminal-modified AFD.v9 Heavy Chain | EVQLVQSGPELKKPGASVKVSCKASGYTFTNYGMNWVRQAPGQGLEWMG WINTYTGETTYAEDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKSKY |
| SEQ ID NO: 802 | C' terminal-modified AFD.v10 Heavy Chain | EVQLVQSGPELKKPGASVKVSCKASGYTFTNYGMNWVRQAPGQGLEWMG WINTYTGETTYAEDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKSKY |
| SEQ ID NO: 803 | C' terminal-modified AFD.v11 Heavy Chain | EVQLVQSGPELKKPGASVKVSCKASGYTFTNYGMNWVRQAPGQGLEWMG WISTYTGETTYAEDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKSKY |
| SEQ ID NO: 804 | C' terminal-modified AFD.v12 Heavy Chain | EVQLVQSGPELKKPGASVKVSCKASGYTFTNYGMNWVRQAPGQGLEWMG WINTYTGETTYAEDFKGRFVFSLDTSVSTAYLQISSLKAEDTAVYYCEREGG VDNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKSKY |

TABLE 8-continued

Heavy chain and light chain amino acid sequences of C' terminal-modified anti-Factor D antibodies

| SEQ ID NO: 805 | C' terminal-modified AFD.v13 Heavy Chain | EVQLVQSGPELKKPGASVKVSCKASGYTFTNYGMNWVRQAPGQGLEWMG<br>WINTYTGETTYAEDFKGRFVFSLDTSVSTAYLQISSLKAEDTAVYYCEREGG<br>VQNWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKSKY |
|---|---|---|
| SEQ ID NO: 806 | C' terminal-modified AFD.v14 Heavy Chain | EVQLVQSGPELKKPGASVKVSCKASGYTFTNYGMNWVRQAPGQGLEWMG<br>WINTYTGETTYAEDFKGRFVFSLDTSVSTAYLQISSLKAEDTAVYYCEREGG<br>VSNWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKSKY |
| SEQ ID NO: 807 | C' terminal-modified AFD.v15 Heavy Chain | EVQLVQSGPELKKPGASVKVSCKASGYTFTNYGMNWVRQAPGQGLEWMG<br>WINTYTGETTYAEDFKGRFVFSLDTSVSTAYLQISSLKAEDTAVYYCEREGG<br>VSNWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKSKY |
| SEQ ID NO: 808 | C' terminal-modified huAFD.v2.0 Heavy Chain | EVQLVQSGAEVKKPGASVKVSCKASGYTFTSYYMYWVRQAPGQGLEWIGE<br>INPTSGGTNFNEKFKSRATLTVDTSTSTAYLELSSLRSEDTAVYYCAREGGFA<br>YVVGQGTLVTVSSASTKGPSVFPLAPSSKSTSGGTAALGCLVKDYFPEPVTVS<br>WNSGALTSGVHTFPAVLQSSGLYSLSSVVTVPSSSLGTQTYICNVNHKPSNT<br>KVDKKVEPKSKY |
| SEQ ID NO: 809 | C' terminal-modified huAFD.v2.1 Heavy Chain | EVQLVQSGAEVKKPGASVKVSCKASGYTFTSYYMYWVRQAPGQGLEWIGE<br>INPTSGGTNFNEKFKSRATLTVDTSTSTAYLELSSLRSEDTAVYYCAREGGFA<br>YVVGQGTLVTVSSASTKGPSVFPLAPSSKSTSGGTAALGCLVKDYFPEPVTVS<br>WNSGALTSGVHTFPAVLQSSGLYSLSSVVTVPSSSLGTQTYICNVNHKPSNT<br>KVDKKVEPKSKY |
| SEQ ID NO: 810 | C' terminal-modified huAFD.v2.3 Heavy Chain | EVQLVQSGAEVKKPGASVKVSCKASGYTFTSYYMYWVRQAPGQGLEWIGE<br>INPYSGDTNFNEKFKSRATLTVDTSTSTAYLELSSLRSEDTAVYYCAREGGFA<br>YVVGQGTLVTVSSASTKGPSVFPLAPSSKSTSGGTAALGCLVKDYFPEPVTVS<br>WNSGALTSGVHTFPAVLQSSGLYSLSSVVTVPSSSLGTQTYICNVNHKPSNT<br>KVDKKVEPKSKY |
| SEQ ID NO: 811 | C' terminal-modified huAFD.v1 Heavy Chain | EVQLVQSGAEVKKPGASVKVSCKASGYTFTSYYMYWVRQAPGQGLEWIGE<br>INPTNGGTNFNEKFKSRATLTVDTSTSTAYLELSSLRSEDTAVYYCAREGGF<br>AYWGQGTLVTVSSASTKGPSVFPLAPSSKSTSGGTAALGCLVKDYFPEPVTV<br>SWNSGALTSGVHTFPAVLQSSGLYSLSSVVTVPSSSLGTQTYICNVNHKPSN<br>TKVDKKVEPKSKY |
| SEQ ID NO: 812 | C' terminal-modified huAFD.v1.1 Heavy Chain | EVQLVQSGAEVKKPGASVKVSCKASGYTFTSYYMYWVRQAPGQGLEWIGE<br>INPTQGGTNFNEKFKSRATLTVDTSTSTAYLELSSLRSEDTAVYYCAREGGF<br>AYWGQGTLVTVSSASTKGPSVFPLAPSSKSTSGGTAALGCLVKDYFPEPVTV<br>SWNSGALTSGVHTFPAVLQSSGLYSLSSVVTVPSSSLGTQTYICNVNHKPSN<br>TKVDKKVEPKSKY |
| SEQ ID NO: 813 | C' terminal-modified huAFD.v2.2 Heavy Chain | EVQLVQSGAEVKKPGASVKVSCKASGYTFTSYYMYWVRQAPGQGLEWIGE<br>INPSGDTNFNEKFKSRATLTVDTSTSTAYLELSSLRSEDTAVYYCAREGGFA<br>YVVGQGTLVTVSSASTKGPSVFPLAPSSKSTSGGTAALGCLVKDYFPEPVTVS<br>WNSGALTSGVHTFPAVLQSSGLYSLSSVVTVPSSSLGTQTYICNVNHKPSNT<br>KVDKKVEPKSKY |
| SEQ ID NO: 814 | C' terminal-modified huAFD.v2.4 Heavy Chain | EVQLVQSGAEVKKPGASVKVSCKASGYTFTSYYMYWVRQAPGQGLEWIGE<br>INPTSGETNFNEKFKSRATLTVDTSTSTAYLELSSLRSEDTAVYYCAREGGFA<br>YVVGQGTLVTVSSASTKGPSVFPLAPSSKSTSGGTAALGCLVKDYFPEPVTVS<br>WNSGALTSGVHTFPAVLQSSGLYSLSSVVTVPSSSLGTQTYICNVNHKPSNT<br>KVDKKVEPKSKY |
| SEQ ID NO: 815 | C' terminal-modified huAFD.v2.5 Heavy Chain | EVQLVQSGAEVKKPGASVKVSCKASGYTFTSYYMYWVRQAPGQGLEWIGE<br>INPYSGGTNFNEKFKSRATLTVDTSTSTAYLELSSLRSEDTAVYYCAREGGFA<br>YVVGQGTLVTVSSASTKGPSVFPLAPSSKSTSGGTAALGCLVKDYFPEPVTVS<br>WNSGALTSGVHTFPAVLQSSGLYSLSSVVTVPSSSLGTQTYICNVNHKPSNT<br>KVDKKVEPKSKY |
| SEQ ID NO: 816 | C' terminal-modified huAFD.v2.6 Heavy Chain | EVQLVQSGAEVKKPGASVKVSCKASGYTFTSYYMYWVRQAPGQGLEWIGE<br>INPTSGGTNFNEKFKSRATLTVDTSTSTAYLELSSLRSEDTAVYYCAREGGFA<br>YVVGQGTLVTVSSASTKGPSVFPLAPSSKSTSGGTAALGCLVKDYFPEPVTVS<br>WNSGALTSGVHTFPAVLQSSGLYSLSSVVTVPSSSLGTQTYICNVNHKPSNT<br>KVDKKVEPKSKY |

TABLE 8-continued

Heavy chain and light chain amino acid sequences of C' terminal-modified anti-Factor D antibodies

| SEQ ID NO: 817 | C' terminal-modified huAFD.v2.7 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*KY* |
| --- | --- | --- |
| SEQ ID NO: 818 | C' terminal-modified huAFD.v2.8 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*KY* |
| SEQ ID NO: 819 | C' terminal-modified huAFD.v2.9 Heavy Chain | EVQLVQSGAEVKKPGASVKVSCKASGYTFTSYYMYWVRQAPGQGLEWIG WINPTSGGTNFNEKFKSRATLTVDTSTSTAYLELSSLRSEDTAVYYCAREGG FAYWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*KY* |
| SEQ ID NO: 820 | C' terminal-modified huAFD.v2.10 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*KY* |
| SEQ ID NO: 821 | C' terminal-modified huAFD.v2.11 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*KY* |
| SEQ ID NO: 822 | C' terminal-modified huAFD.v2.12 Heavy Chain | EVQLVQSGAEVKKPGASVKVSCKASGYTFTSYYMYWVRQAPGQGLEWIGE INPYSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*KY* |
| SEQ ID NO: 823 | C' terminal-modified huAFD.v2.13 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*KY* |
| SEQ ID NO: 824 | C' terminal-modified huAFD.v2.14 Heavy Chain | EVQLVQSGAEVKKPGASVKVSCKASGYTFTSYYMYWVRQAPGQGLEWIGE INPTSGETNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*KY* |
| SEQ ID NO: 825 | C' terminal-modified huAFD.v2.15 Heavy Chain | EVQLVQSGAEVKKPGASVKVSCKASGYTFTSYYMYWVRQAPGQGLEWIGE INPYSGETNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*KY* |
| SEQ ID NO: 826 | C' terminal-modified AFD WT Heavy Chain | EVQLVQSGPELKKPGASVKVSCKASGYTFTNYGMNWVRQAPGQGLEWMG WINTYTGETTYADDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*K* |
| SEQ ID NO: 827 | C' terminal-modified AFD.v1 Heavy Chain | EVQLVQSGPELKKPGASVKVSCKASGYTFTNYGMNWVRQAPGQGLEWMG WINTYTGETTYADDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*K* |
| SEQ ID NO: 828 | C' terminal-modified AFD.v2 Heavy Chain | EVQLVQSGPELKKPGASVKVSCKASGYTFTNYGMNWVRQAPGQGLEWMG WINTYTGETTYADDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*K* |

TABLE 8-continued

Heavy chain and light chain amino acid sequences of C' terminal-modified anti-Factor D antibodies

| SEQ ID NO: 829 | C' terminal-modified AFD.v3 Heavy Chain | EVQLVQSGPELKKPGASVKVSCKASGYTFTNYGMNWVRQAPGQGLEWMG<br>WINTYTGETTYADDFKGRFVFSLDTSVSTAYLQISSLKAEDTAVYYCEREGG<br>VNNWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKS*K* |
| --- | --- | --- |
| SEQ ID NO: 830 | C' terminal-modified AFD.v4 Heavy Chain | EVQLVQSGPELKKPGASVKVSCKASGYTFTNYGMNWVRQAPGQGLEWMG<br>WINTYTGETTYADDFKGRFVFSLDTSVSTAYLQISSLKAEDTAVYYCEREGG<br>VNNWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKS*K* |
| SEQ ID NO: 831 | C' terminal-modified AFD.v5 Heavy Chain | EVQLVQSGPELKKPGASVKVSCKASGYTFTNYGMNWVRQAPGQGLEWMG<br>WINTYTGETTYADDFKGRFVFSLDTSVSTAYLQISSLKAEDTAVYYCEREGG<br>VNNWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKS*K* |
| SEQ ID NO: 832 | C' terminal-modified AFD.v6 Heavy Chain | EVQLVQSGPELKKPGASVKVSCKASGYTFTNYGMNWVRQAPGQGLEWMG<br>WINTYTGETTYAEDFKGRFVFSLDTSVSTAYLQISSLKAEDTAVYYCEREGG<br>VNNWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKS*K* |
| SEQ ID NO: 833 | C' terminal-modified AFD.v7 Heavy Chain | EVQLVQSGPELKKPGASVKVSCKASGYTFTNYGMNWVRQAPGQGLEWMG<br>WINTYTGETTYAEDFKGRFVFSLDTSVSTAYLQISSLKAEDTAVYYCEREGG<br>VNNWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKS*K* |
| SEQ ID NO: 834 | C' terminal-modified AFD.v8 Heavy Chain | EVQLVQSGPELKKPGASVKVSCKASGYTFTNYGMNWVRQAPGQGLEWMG<br>WINTYTGETTYAEDFKGRFVFSLDTSVSTAYLQISSLKAEDTAVYYCEREGG<br>VNNWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKS*K* |
| SEQ ID NO: 835 | C' terminal-modified AFD.v9 Heavy Chain | EVQLVQSGPELKKPGASVKVSCKASGYTFTNYGMNWVRQAPGQGLEWMG<br>WINTYTGETTYAEDFKGRFVFSLDTSVSTAYLQISSLKAEDTAVYYCEREGG<br>VNNWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKS*K* |
| SEQ ID NO: 836 | C' terminal-modified AFD.v10 Heavy Chain | EVQLVQSGPELKKPGASVKVSCKASGYTFTNYGMNWVRQAPGQGLEWMG<br>WINTYTGETTYAEDFKGRFVFSLDTSVSTAYLQISSLKAEDTAVYYCEREGG<br>VNNWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKS*K* |
| SEQ ID NO: 837 | C' terminal-modified AFD.v11 Heavy Chain | EVQLVQSGPELKKPGASVKVSCKASGYTFTNYGMNWVRQAPGQGLEWMG<br>WISTYTGETTYAEDFKGRFVFSLDTSVSTAYLQISSLKAEDTAVYYCEREGG<br>VNNWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKS*K* |
| SEQ ID NO: 838 | C' terminal-modified AFD.v12 Heavy Chain | EVQLVQSGPELKKPGASVKVSCKASGYTFTNYGMNWVRQAPGQGLEWMG<br>WINTYTGETTYAEDFKGRFVFSLDTSVSTAYLQISSLKAEDTAVYYCEREGG<br>VDNWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKS*K* |
| SEQ ID NO: 839 | C' terminal-modified AFD.v13 Heavy Chain | EVQLVQSGPELKKPGASVKVSCKASGYTFTNYGMNWVRQAPGQGLEWMG<br>WINTYTGETTYAEDFKGRFVFSLDTSVSTAYLQISSLKAEDTAVYYCEREGG<br>VQNWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKS*K* |
| SEQ ID NO: 840 | C' terminal-modified AFD.v14 Heavy Chain | EVQLVQSGPELKKPGASVKVSCKASGYTFTNYGMNWVRQAPGQGLEWMG<br>WINTYTGETTYAEDFKGRFVFSLDTSVSTAYLQISSLKAEDTAVYYCEREGG<br>VSNWGQGTLVTVSSASTKGPSVFPLAPSSKSTSGGTAALGCLVKDYFPEPVT<br>VSWNSGALTSGVHTFPAVLQSSGLYSLSSVVTVPSSSLGTQTYICNVNHKPS<br>NTKVDKKVEPKS*K* |

TABLE 8-continued

Heavy chain and light chain amino acid sequences of C' terminal-modified anti-Factor D antibodies

| SEQ ID NO: 841 | C' terminal-modified AFD.v15 Heavy Chain | EVQLVQSGPELKKPGASVKVSCKASGYTFTNYGMNWVRQAPGQGLEWMG WINTYTGETTYAEDFKGRFVFSLDTSVSTAYLQISSLKAEDTAVYYCEREGG VSNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*K* |
|---|---|---|
| SEQ ID NO: 842 | C' terminal-modified huAFD.v2.0 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*K* |
| SEQ ID NO: 843 | C' terminal-modified huAFD.v2.1 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*K* |
| SEQ ID NO: 844 | C' terminal-modified huAFD.v2.3 Heavy Chain | EVQLVQSGAEVKKPGASVKVSCKASGYTFTSYYMYWVRQAPGQGLEWIGE INPYSGDTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*K* |
| SEQ ID NO: 845 | C' terminal-modified huAFD.v1 Heavy Chain | EVQLVQSGAEVKKPGASVKVSCKASGYTFTSYYMYWVRQAPGQGLEWIGE INPTNGGTNFNEKFKSRATLTVDTSTSTAYLELSSLRSEDTAVYYCAREGGF AYWGQGTLVTVSSASTKGPSVFPLAPSSKSTSGGTAALGCLVKDYFPEPVTV SWNSGALTSGVHTFPAVLQSSGLYSLSSVVTVPSSSLGTQTYICNVNHKPSN TKVDKKVEPKS*K* |
| SEQ ID NO: 846 | C' terminal-modified huAFD.v1.1 Heavy Chain | EVQLVQSGAEVKKPGASVKVSCKASGYTFTSYYMYWVRQAPGQGLEWIGE INPTQGGTNFNEKFKSRATLTVDTSTSTAYLELSSLRSEDTAVYYCAREGGF AYWGQGTLVTVSSASTKGPSVFPLAPSSKSTSGGTAALGCLVKDYFPEPVTV SWNSGALTSGVHTFPAVLQSSGLYSLSSVVTVPSSSLGTQTYICNVNHKPSN TKVDKKVEPKS*K* |
| SEQ ID NO: 847 | C' terminal-modified huAFD.v2.2 Heavy Chain | EVQLVQSGAEVKKPGASVKVSCKASGYTFTSYYMYWVRQAPGQGLEWIGE INPTSGDTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*K* |
| SEQ ID NO: 848 | C' terminal-modified huAFD.v2.4 Heavy Chain | EVQLVQSGAEVKKPGASVKVSCKASGYTFTSYYMYWVRQAPGQGLEWIGE INPTSGETNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*K* |
| SEQ ID NO: 849 | C' terminal-modified huAFD.v2.5 Heavy Chain | EVQLVQSGAEVKKPGASVKVSCKASGYTFTSYYMYWVRQAPGQGLEWIGE INPYSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*K* |
| SEQ ID NO: 850 | C' terminal-modified huAFD.v2.6 Heavy Chain | EVQLVQSGAEVKKPGASVKVSCKASGYTFTSYYMYWVRQAPGQGLEWIGE INPSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*K* |
| SEQ ID NO: 851 | C' terminal-modified huAFD.v2.7 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*K* |
| SEQ ID NO: 852 | C' terminal-modified huAFD.v2.8 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*K* |

TABLE 8-continued

Heavy chain and light chain amino acid sequences of C' terminal-modified anti-Factor D antibodies

| SEQ ID NO: 853 | C' terminal-modified huAFD.v2.9 Heavy Chain | EVQLVQSGAEVKKPGASVKVSCKASGYTFTSYYMYWVRQAPGQGLEWIG WINPTSGGTNFNEKFKSRATLTVDTSTSTAYLELSSLRSEDTAVYYCAREGG FAYWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*K* |
|---|---|---|
| SEQ ID NO: 854 | C' terminal-modified huAFD.v2.10 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*K* |
| SEQ ID NO: 855 | C' terminal-modified huAFD.v2.11 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*K* |
| SEQ ID NO: 856 | C' terminal-modified huAFD.v2.12 Heavy Chain | EVQLVQSGAEVKKPGASVKVSCKASGYTFTSYYMYWVRQAPGQGLEWIGE INPYSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*K* |
| SEQ ID NO: 857 | C' terminal-modified huAFD.v2.13 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*K* |
| SEQ ID NO: 858 | C' terminal-modified huAFD.v2.14 Heavy Chain | EVQLVQSGAEVKKPGASVKVSCKASGYTFTSYYMYWVRQAPGQGLEWIGE INPTSGETNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*K* |
| SEQ ID NO: 859 | C' terminal-modified huAFD.v2.15 Heavy Chain | EVQLVQSGAEVKKPGASVKVSCKASGYTFTSYYMYWVRQAPGQGLEWIGE INPYSGETNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*K* |
| SEQ ID NO: 882 | C' terminal-modified AFD WT Heavy Chain | EVQLVQSGPELKKPGASVKVSCKASGYTFTNYGMNWVRQAPGQGLEWMG WINTYTGETTYADDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDKTHX* (X is any amino acid except T) |
| SEQ ID NO: 883 | C' terminal-modified AFD.v1 Heavy Chain | EVQLVQSGPELKKPGASVKVSCKASGYTFTNYGMNWVRQAPGQGLEWMG WINTYTGETTYADDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDKTHX* (X is any amino acid except T) |
| SEQ ID NO: 884 | C' terminal-modified AFD.v2 Heavy Chain | EVQLVQSGPELKKPGASVKVSCKASGYTFTNYGMNWVRQAPGQGLEWMG WINTYTGETTYADDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDKTHX* (X is any amino acid except T) |
| SEQ ID NO: 885 | C' terminal-modified AFD.v3 Heavy Chain | EVQLVQSGPELKKPGASVKVSCKASGYTFTNYGMNWVRQAPGQGLEWMG WINTYTGETTYADDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDKTHX* (X is any amino acid except T) |
| SEQ ID NO: 886 | C' terminal-modified AFD.v4 Heavy Chain | EVQLVQSGPELKKPGASVKVSCKASGYTFTNYGMNWVRQAPGQGLEWMG WINTYTGETTYADDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDKTHX* (X is any amino acid except T) |

TABLE 8-continued

Heavy chain and light chain amino acid sequences of C' terminal-modified anti-Factor D antibodies

| SEQ ID NO: 887 | C' terminal-modified AFD.v5 Heavy Chain | EVQLVQSGPELKKPGASVKVSCKASGYTFTNYGMNWVRQAPGQGLEWMG WINTYTGETTYADDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDKTHX* (X is any amino acid except T) |
|---|---|---|
| SEQ ID NO: 888 | C' terminal-modified AFD.v6 Heavy Chain | EVQLVQSGPELKKPGASVKVSCKASGYTFTNYGMNWVRQAPGQGLEWMG WINTYTGETTYAEDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDKTHX* (X is any amino acid except T) |
| SEQ ID NO: 889 | C' terminal-modified AFD.v7 Heavy Chain | EVQLVQSGPELKKPGASVKVSCKASGYTFTNYGMNWVRQAPGQGLEWMG WINTYTGETTYAEDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDKTHX* (X is any amino acid except T) |
| SEQ ID NO: 890 | C' terminal-modified AFD.v8 Heavy Chain | EVQLVQSGPELKKPGASVKVSCKASGYTFTNYGMNWVRQAPGQGLEWMG WINTYTGETTYAEDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDKTHX* (X is any amino acid except T) |
| SEQ ID NO: 891 | C' terminal-modified AFD.v9 Heavy Chain | EVQLVQSGPELKKPGASVKVSCKASGYTFTNYGMNWVRQAPGQGLEWMG WINTYTGETTYAEDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDKTHX* (X is any amino acid except T) |
| SEQ ID NO: 892 | C' terminal-modified AFD.v10 Heavy Chain | EVQLVQSGPELKKPGASVKVSCKASGYTFTNYGMNWVRQAPGQGLEWMG WINTYTGETTYAEDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDKTHX* (X is any amino acid except T) |
| SEQ ID NO: 893 | C' terminal-modified AFD.v11 Heavy Chain | EVQLVQSGPELKKPGASVKVSCKASGYTFTNYGMNWVRQAPGQGLEWMG WISTYTGETTYAEDFKGRFVFSLDTSVSTAYLQISSLKAEDTAVYYCEREGG VNNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDKTHX* (X is any amino acid except T) |
| SEQ ID NO: 894 | C' terminal-modified AFD.v12 Heavy Chain | EVQLVQSGPELKKPGASVKVSCKASGYTFTNYGMNWVRQAPGQGLEWMG WINTYTGETTYAEDFKGRFVFSLDTSVSTAYLQISSLKAEDTAVYYCEREGG VDNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDKTHX* (X is any amino acid except T) |
| SEQ ID NO: 895 | C' terminal-modified AFD.v13 Heavy Chain | EVQLVQSGPELKKPGASVKVSCKASGYTFTNYGMNWVRQAPGQGLEWMG WINTYTGETTYAEDFKGRFVFSLDTSVSTAYLQISSLKAEDTAVYYCEREGG VQNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDKTHX* (X is any amino acid except T) |
| SEQ ID NO: 896 | C' terminal-modified AFD.v14 Heavy Chain | EVQLVQSGPELKKPGASVKVSCKASGYTFTNYGMNWVRQAPGQGLEWMG WINTYTGETTYAEDFKGRFVFSLDTSVSTAYLQISSLKAEDTAVYYCEREGG VSNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDKTHX* (X is any amino acid except T) |
| SEQ ID NO: 897 | C' terminal-modified AFD.v15 Heavy Chain | EVQLVQSGPELKKPGASVKVSCKASGYTFTNYGMNWVRQAPGQGLEWMG WINTYTGETTYAEDFKGRFVFSLDTSVSTAYLQISSLKAEDTAVYYCEREGG VSNWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDKTHX* (X is any amino acid except T) |
| SEQ ID NO: 898 | C' terminal-modified huAFD.v2.0 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDKTHX* (X is any amino acid except T) |

TABLE 8-continued

Heavy chain and light chain amino acid sequences of C' terminal-modified anti-Factor D antibodies

| SEQ ID NO: 899 | C' terminal-modified huAFD.v2.1 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDKTHX* (X is any amino acid except T) |
| --- | --- | --- |
| SEQ ID NO: 900 | C' terminal-modified huAFD.v2.3 Heavy Chain | EVQLVQSGAEVKKPGASVKVSCKASGYTFTSYYMYWVRQAPGQGLEWIGE INPYSGDTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDKTHX* (X is any amino acid except T) |
| SEQ ID NO: 901 | C' terminal-modified huAFD.v1 Heavy Chain | EVQLVQSGAEVKKPGASVKVSCKASGYTFTSYYMYWVRQAPGQGLEWIGE INPTNGGTNFNEKFKSRATLTVDTSTSTAYLELSSLRSEDTAVYYCAREGGF AYWGQGTLVTVSSASTKGPSVFPLAPSSKSTSGGTAALGCLVKDYFPEPVTV SWNSGALTSGVHTFPAVLQSSGLYSLSSVVTVPSSSLGTQTYICNVNHKPSN TKVDKKVEPKS*CDKTHX* (X is any amino acid except T) |
| SEQ ID NO: 902 | C' terminal-modified huAFD.v1.1 Heavy Chain | EVQLVQSGAEVKKPGASVKVSCKASGYTFTSYYMYWVRQAPGQGLEWIGE INPTQGGTNFNEKFKSRATLTVDTSTSTAYLELSSLRSEDTAVYYCAREGGF AYWGQGTLVTVSSASTKGPSVFPLAPSSKSTSGGTAALGCLVKDYFPEPVTV SWNSGALTSGVHTFPAVLQSSGLYSLSSVVTVPSSSLGTQTYICNVNHKPSN TKVDKKVEPKS*CDKTHX* (X is any amino acid except T) |
| SEQ ID NO: 903 | C' terminal-modified huAFD.v2.2 Heavy Chain | EVQLVQSGAEVKKPGASVKVSCKASGYTFTSYYMYWVRQAPGQGLEWIGE INPTSGDTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDKTHX* (X is any amino acid except T) |
| SEQ ID NO: 904 | C' terminal-modified huAFD.v2.4 Heavy Chain | EVQLVQSGAEVKKPGASVKVSCKASGYTFTSYYMYWVRQAPGQGLEWIGE INPTSGETNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDKTHX* (X is any amino acid except T) |
| SEQ ID NO: 905 | C' terminal-modified huAFD.v2.5 Heavy Chain | EVQLVQSGAEVKKPGASVKVSCKASGYTFTSYYMYWVRQAPGQGLEWIGE INPYSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDKTHX* (X is any amino acid except T) |
| SEQ ID NO: 906 | C' terminal-modified huAFD.v2.6 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDKTHX* (X is any amino acid except T) |
| SEQ ID NO: 907 | C' terminal-modified huAFD.v2.7 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDKTHX* (X is any amino acid except T) |
| SEQ ID NO: 908 | C' terminal-modified huAFD.v2.8 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDKTHX* (X is any amino acid except T) |
| SEQ ID NO: 909 | C' terminal-modified huAFD.v2.9 Heavy Chain | EVQLVQSGAEVKKPGASVKVSCKASGYTFTSYYMYWVRQAPGQGLEWIG WINPTSGGTNFNEKFKSRATLTVDTSTSTAYLELSSLRSEDTAVYYCAREGG FAYWGQGTLVTVSSASTKGPSVFPLAPSSKSTSGGTAALGCLVKDYFPEPVT VSWNSGALTSGVHTFPAVLQSSGLYSLSSVVTVPSSSLGTQTYICNVNHKPS NTKVDKKVEPKS*CDKTHX* (X is any amino acid except T) |
| SEQ ID NO: 910 | C' terminal-modified huAFD.v2.10 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDKTHX* (X is any amino acid except T) |

TABLE 8-continued

Heavy chain and light chain amino acid sequences of C' terminal-modified anti-Factor D antibodies

| | | |
|---|---|---|
| SEQ ID NO: 911 | C' terminal-modified huAFD.v2.11 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDKTHX* (X is any amino acid except T) |
| SEQ ID NO: 912 | C' terminal-modified huAFD.v2.12 Heavy Chain | EVQLVQSGAEVKKPGASVKVSCKASGYTFTSYYMYWVRQAPGQGLEWIGE INPYSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDKTHX* (X is any amino acid except T) |
| SEQ ID NO: 913 | C' terminal-modified huAFD.v2.13 Heavy Chain | EVQLVQSGAEVKKPGASVKVSCKASGYTFTSYYMYWVRQAPGQGLEWIGE INPTSGGTNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDKTHX* (X is any amino acid except T) |
| SEQ ID NO: 914 | C' terminal-modified huAFD.v2.14 Heavy Chain | EVQLVQSGAEVKKPGASVKVSCKASGYTFTSYYMYWVRQAPGQGLEWIGE INPTSGETNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDKTHX* (X is any amino acid except T) |
| SEQ ID NO: 915 | C' terminal-modified huAFD.v2.15 Heavy Chain | EVQLVQSGAEVKKPGASVKVSCKASGYTFTSYYMYWVRQAPGQGLEWIGE INPYSGETNFNEKFKSRATLTVDTSTSTAYLELSSLRSEDTAVYYCAREGGFA YVVGQGTLVTVSSASTKGPSVFPLAPSSKSTSGGTAALGCLVKDYFPEPVTVS WNSGALTSGVHTFPAVLQSSGLYSLSSVVTVPSSSLGTQTYICNVNHKPSNT KVDKKVEPKS*CDKTHX* (X is any amino acid except T) |

In some embodiments, the anti-Factor D antibody is a Fab fragment, a Fab' fragment or a F(ab')2 fragment comprising a light chain constant region having the amino acid sequence of SEQ ID NO: 860. In some embodiments, the anti-Factor D antibody is a Fab fragment, a Fab' fragment or a F(ab')2 fragment comprising a light chain constant region having at least 90% sequence identity to the amino acid sequence of SEQ ID NO: 860. See Table 9.

In some embodiments, the anti-Factor D antibody is a Fab fragment comprising a heavy chain constant region having the amino acid sequence of SEQ ID NO: 861, SEQ ID NO: 862, SEQ ID NO: 869, SEQ ID NO: 870, SEQ ID NO: 871, SEQ ID NO: 872, SEQ ID NO: 873, SEQ ID NO: 874, SEQ ID NO: 877, SEQ ID NO: 878, SEQ ID NO: 879, SEQ ID NO: 880, SEQ ID NO: 881, or SEQ ID NO: 916. In some embodiments, the anti-Factor D antibody is a Fab fragment, a Fab' fragment or a F(ab')2 fragment comprising a heavy chain constant region having the amino acid sequence of SEQ ID NO: 864, SEQ ID NO: 865, SEQ ID NO: 866, SEQ ID NO: 867, or SEQ ID NO: 868. In some embodiments, the anti-Factor D antibody is a Fab-C fragment comprising a heavy chain constant region having the amino acid sequence of SEQ ID NO: 863, SEQ ID NO: 875, or SEQ ID NO: 876. In some embodiments, the anti-Factor D antibody is a Fab fragment comprising a heavy chain constant region having at least 90% sequence identity to the amino acid sequence of SEQ ID NO: 861, SEQ ID NO: 862, SEQ ID NO: 869, SEQ ID NO: 870, SEQ ID NO: 871, SEQ ID NO: 872, SEQ ID NO: 873, SEQ ID NO: 874, SEQ ID NO: 877, SEQ ID NO: 878, SEQ ID NO: 879, SEQ ID NO: 880, SEQ ID NO: 881, or SEQ ID NO: 916. In some embodiments, the anti-Factor D antibody is a Fab fragment, a Fab' fragment or a F(ab')2 fragment comprising a heavy chain constant region having at least 90% sequence identity to the amino acid sequence of SEQ ID NO: 864, SEQ ID NO: 865, SEQ ID NO: 866, SEQ ID NO: 867, or SEQ ID NO: 868. In some embodiments, the anti-Factor D antibody is a Fab-C fragment comprising a heavy chain constant region having at least 90% sequence identity to the amino acid sequence of SEQ ID NO: 863, SEQ ID NO: 875, or SEQ ID NO: 876. See Table 9.

TABLE 9

Amino acid sequences of anti-Factor D antibody light chain constant regions and heavy chain constant regions

| | |
|---|---|
| SEQ ID NO: 860 | RTVAAPSVFIFPPSDEQLKSGTASVVCLLNNFYPREAKVQWKVDNALQSGNSQESVTEQDSKDSTYSLS STLTLSKADYEKHKVYACEVTHQGLSSPVTKSFNRGEC |
| SEQ ID NO: 861 | ASTKGPSVFPLAPSSKSTSGGTAALGCLVKDYFPEPVTVSWNSGALTSGVHTFPAVLQSSGLYSLSSVVT VPSSSLGTQTYICNVNHKPSNTKVDKKVEPKSCDKTHT |
| SEQ ID NO: 862 | ASTKGPSVFPLAPSSKSTSGGTAALGCLVKDYFPEPVTVSWNSGALTSGVHTFPAVLQSSGLYSLSSVVT VPSSSLGTQTYICNVNHKPSNTKVDKKVEPKSCDKTHL |
| SEQ ID NO: 863 | ASTKGPSVFPLAPSSKSTSGGTAALGCLVKDYFPEPVTVSWNSGALTSGVHTFPAVLQSSGLYSLSSVVT VPSSSLGTQTYICNVNHKPSNTKVDKKVEPKSCDKTHTC |

TABLE 9-continued

Amino acid sequences of anti-Factor D antibody light chain constant regions and heavy chain constant regions

| | |
|---|---|
| SEQ ID NO: 864 | ASTKGPSVFPLAPSSKSTSGGTAALGCLVKDYFPEPVTVSWNSGALTSGVHTFPAVLQSSGLYSLSSVVT VPSSSLGTQTYICNVNHKPSNTKVDKKVEPKSCDKTHTCPPC |
| SEQ ID NO: 865 | ASTKGPSVFPLAPSSKSTSGGTAALGCLVKDYFPEPVTVSWNSGALTSGVHTFPAVLQSSGLYSLSSVVT VPSSSLGTQTYICNVNHKPSNTKVDKKVEPKSCDKTHTCPPS |
| SEQ ID NO: 866 | ASTKGPSVFPLAPSSKSTSGGTAALGCLVKDYFPEPVTVSWNSGALTSGVHTFPAVLQSSGLYSLSSVVT VPSSSLGTQTYICNVNHKPSNTKVDKKVEPKSCDKTHTSPPC |
| SEQ ID NO: 867 | ASTKGPSVFPLAPSSKSTSGGTAALGCLVKDYFPEPVTVSWNSGALTSGVHTFPAVLQSSGLYSLSSVVT VPSSSLGTQTYICNVNHKPSNTKVDKKVEPKSCDKTHTAPPC |
| SEQ ID NO: 868 | ASTKGPSVFPLAPSSKSTSGGTAALGCLVKDYFPEPVTVSWNSGALTSGVHTFPAVLQSSGLYSLSSVVT VPSSSLGTQTYICNVNHKPSNTKVDKKVEPKSCDKTHTSGGC |
| SEQ ID NO: 869 | ASTKGPSVFPLAPSSKSTSGGTAALGCLVKDYFPEPVTVSWNSGALTSGVHTFPAVLQSSGLYSLSSVVT VPSSSLGTQTYICNVNHKPSNTKVDKKVEPKSCYGPPC |
| SEQ ID NO: 870 | ASTKGPSVFPLAPSSKSTSGGTAALGCLVKDYFPEPVTVSWNSGALTSGVHTFPAVLQSSGLYSLSSVVT VPSSSLGTQTYICNVNHKPSNTKVDKKVEPKSCDKTH |
| SEQ ID NO: 871 | ASTKGPSVFPLAPSSKSTSGGTAALGCLVKDYFPEPVTVSWNSGALTSGVHTFPAVLQSSGLYSLSSVVT VPSSSLGTQTYICNVNHKPSNTKVDKKVEPKSCDKT |
| SEQ ID NO: 872 | ASTKGPSVFPLAPSSKSTSGGTAALGCLVKDYFPEPVTVSWNSGALTSGVHTFPAVLQSSGLYSLSSVVT VPSSSLGTQTYICNVNHKPSNTKVDKKVEPKSCDK |
| SEQ ID NO: 873 | ASTKGPSVFPLAPSSKSTSGGTAALGCLVKDYFPEPVTVSWNSGALTSGVHTFPAVLQSSGLYSLSSVVT VPSSSLGTQTYICNVNHKPSNTKVDKKVEPKSCD |
| SEQ ID NO: 874 | ASTKGPSVFPLAPCSRSTSESTAALGCLVKDYFPEPVTVSWNSGALTSGVHTFPAVLQSSGLYSLSSVVT VPSSNFGTQTYTCNVDHKPSNTKVDKTVERK |
| SEQ ID NO: 875 | ASTKGPSVFPLAPCSRSTSESTAALGCLVKDYFPEPVTVSWNSGALTSGVHTFPAVLQSSGLYSLSSVVT VPSSNFGTQTYTCNVDHKPSNTKVDKTVERKC |
| SEQ ID NO: 876 | ASTKGPSVFPLAPCSRSTSESTAALGCLVKDYFPEPVTVSWNSGALTSGVHTFPAVLQSSGLYSLSSVVT VPSSSLGTKTYTCNVDHKPSNTKVDKRVESKYGPPC |
| SEQ ID NO: 877 | ASTKGPSVFPLAPCSRSTSESTAALGCLVKDYFPEPVTVSWNSGALTSGVHTFPAVLQSSGLYSLSSVVT VPSSSLGTKTYTCNVDHKPSNTKVDKRVESKYGPP |
| SEQ ID NO: 878 | ASTKGPSVFPLAPCSRSTSESTAALGCLVKDYFPEPVTVSWNSGALTSGVHTFPAVLQSSGLYSLSSVVT VPSSSLGTKTYTCNVDHKPSNTKVDKRVESKYGP |
| SEQ ID NO: 879 | ASTKGPSVFPLAPCSRSTSESTAALGCLVKDYFPEPVTVSWNSGALTSGVHTFPAVLQSSGLYSLSSVVT VPSSSLGTKTYTCNVDHKPSNTKVDKRVESKYG |
| SEQ ID NO: 880 | ASTKGPSVFPLAPCSRSTSESTAALGCLVKDYFPEPVTVSWNSGALTSGVHTFPAVLQSSGLYSLSSVVT VPSSSLGTKTYTCNVDHKPSNTKVDKRVESKY |
| SEQ ID NO: 881 | ASTKGPSVFPLAPCSRSTSESTAALGCLVKDYFPEPVTVSWNSGALTSGVHTFPAVLQSSGLYSLSSVVT VPSSSLGTKTYTCNVDHKPSNTKVDKRVESK |
| SEQ ID NO: 916 | ASTKGPSVFPLAPSSKSTSGGTAALGCLVKDYFPEPVTVSWNSGALTSGVHTFPAVLQSSGLYSLSSVVT VPSSS LGTQTYICNVNHKPSNTKVDKKVEPKSCDKTHX (X is any amino acid except T) |

In specific embodiments, the Factor D inhibitor is a small molecule inhibitor. In specific embodiments, the Factor D inhibitor is a nucleotide (e.g., a DNA, an RNA, an shRNA, an miRNA, an siRNA, an antisense DNA). In specific embodiments, the Factor D inhibitor is a peptide, a protein, a peptide mimetic, an aptamer, or any other molecule that binds to Factor D.

In the methods of determining the potency of a Factor D inhibitor described above, the anti-Factor Ba, anti-Factor Bb, and/or anti-Factor C3b may be replaced by a peptide, a non-antibody protein, a peptide memetic, an aptamer, a nucleotide (e.g., DNA, RNA, shRNA, miRNA, siRNA, antisense DNA), or any other molecule that binds to Factor Ba, Factor Bb, or anti-Factor C3b, respectively. Alternatively, the Factor Ba, Factor Bb, and/or Factor C3b may be directed attached to the donor or acceptor (as the case may be) by direct chemical labeling.

In specific embodiments of the methods of determining the potency of a Factor D inhibitor described herein, the Factor D is a recombinantly expressed Factor D. In specific embodiments of the methods of determining the potency of a Factor D inhibitor described herein, the Factor D is endogenously expressed Factor D purified from a sample derived from a subject.

In specific embodiments of the methods of determining the potency of a Factor D inhibitor described herein, the Factor B is a recombinantly expressed Factor B. In specific embodiments of the methods of determining the potency of a Factor D inhibitor described herein, the Factor B is endogenously expressed Factor B purified from a sample derived from a subject.

The term "sample" referred to in the methods described herein, can be, but is not limited to, a blood sample or a serum sample.

The subject referred to in the methods described herein, can be, but is not limited to, a human or non-human vertebrate such as a wild, domestic or farm animal. In certain embodiments, the subject is a mammal, e.g., a human, a cow, a dog, a cat, a goat, a horse, a sheep, a pig, a rat, or a mouse. In a preferred embodiment, the subject is a human.

5.5. Methods of Screening for Factor D Inhibitors

In another aspect, provided herein are methods of screening for a Factor D inhibitor from a plurality of Factor D inhibitor candidates, comprising performing a proximity-based measurement assay, wherein the proximity-based measurement assay measures the cleavage of Factor B. The proximity-based measurement assay can utilize any proximity-based technology known in the art for measuring the binding of a protein pair, as described in Section 5.1. The methods described in this section are useful, for example, in high-throughput screening for new Factor D inhibitors.

In various embodiments, the methods of screening for a Factor D inhibitor comprise: (a) mixing a Factor D inhibitor candidate with Factor D, Factor B and Factor C3b in a test reaction mix; (b) incubating the test reaction mix; (c) adding to the test reaction mix an anti-Factor Ba antibody labeled with a first moiety and an anti-Factor Bb antibody labeled with a second moiety after the step of (b), wherein one of the moieties is a donor, and the other is an acceptor, and wherein a proximity signal generated by the acceptor and/or the donor indicates that Factor Ba and Factor Bb are in proximity; and (d) measuring the value of the proximity signal from the test reaction mix; wherein the degree of Factor D activity inhibition by a Factor D candidate is positively correlated with the value of the proximity signal. In certain embodiments, the steps of (a)-(d) are carried out for each Factor D inhibitor candidate from the plurality.

In certain aspects of such various embodiments, the methods of screening for a Factor D inhibitor further comprise: (e) mixing a control reaction mix; (f) incubating the control reaction mix; (g) adding to the control reaction mix the anti-Factor Ba antibody labeled with the first moiety and the anti-Factor Bb antibody labeled with the second moiety after the step of (f); and (h) measuring the value of the proximity signal from the control test reaction mix; wherein a greater value of the proximity signal from the test reaction mix relative to the control reaction mix (e.g., about 10%, 15%, 20%, 25%, 30%, 40%, 50%, 60%, 70%, 80%, 90% greater or more, or about 1-fold, 1.5-fold, 2-fold, 3-fold, 4-fold, 5-fold, 6-fold, 7-fold, 8-fold, 9-fold, 10-fold, 15-fold, 20-fold, 30-fold, 40-fold, 50-fold greater or more) indicates a greater inhibition of Factor D activity by the Factor D inhibitor candidate in the test reaction mix relative to the control reaction mix.

When the proximity signal generated by the donor and/or the acceptor is based on energy transfer between the donor and the acceptor upon light activation, in various embodiments, the methods of screening for a Factor D inhibitor comprise: (A) mixing a Factor D inhibitor candidate with Factor D, Factor B and Factor C3b in a test reaction mix; (B) incubating the test reaction mix; (C) adding to the test reaction mix an anti-Factor Ba antibody labeled with a first moiety and an anti-Factor Bb antibody labeled with a second moiety after the step of (B), wherein one of the moieties is a donor, and the other is an acceptor; (D) providing a light source to excite the donor in the test reaction mix; and (E) measuring the donor fluorescence emission intensity from the test reaction mix, and/or the acceptor fluorescence emission intensity from the test reaction mix; wherein the degree of Factor D activity inhibition by a Factor D candidate is negatively correlated with the donor fluorescence emission intensity from the test reaction mix, and/or is positively correlated with the acceptor fluorescence emission intensity from the test reaction mix. In specific embodiments, the step of (B) is conducted for about 15 min, 30 min, 45 min, 60 min, 75 min, or 90 min. In some embodiments, the step of (B) is conducted for about 45 min. In certain embodiments, the step of (E) is performed after a period of time of the step of (D) that results in a decrease in interfering short-lived background signals. In specific embodiments, the methods of screening for a Factor D inhibitor further comprise: (F) mixing a control reaction mix; (G) incubating the control reaction mix; (H) adding to the control reaction mix the anti-Factor Ba antibody labeled with the first moiety and the anti-Factor Bb antibody labeled with the second moiety after the step of (G); (I) providing the same light source to excite the donor in the control reaction mix; and (J) measuring the donor fluorescence emission intensity from the control reaction mix, and/or the acceptor fluorescence emission intensity from the control reaction mix; wherein a lower donor fluorescence emission intensity from the test reaction mix relative to the control reaction mix, and/or a higher acceptor fluorescence emission intensity from the test reaction mix relative to the control reaction mix, indicates a greater inhibition of Factor D activity by the Factor D inhibitor candidate in the test reaction mix relative to the control reaction mix. In specific embodiments, the steps of (B) and (G) are conducted for about 15 min, 30 min, 45 min, 60 min, 75 min, or 90 min. In some embodiments, the steps of (B) and (G) are conducted for about 45 min. In certain embodiments, the step of (E) is performed after a period of time of the step of (D) that results in a decrease in interfering short-lived background signals, and the step of (J) is performed after the same period of time of the step of (J). In certain embodiments, the steps of (A)-(E) are carried out for each Factor D inhibitor candidate from the plurality.

In certain embodiments, the anti-Factor Ba antibody and the anti-Factor Bb antibody used in the methods of screening for a Factor D inhibitor quench the activity of Factor D. In such embodiments, the need to add another quencher specifically is obviated. In certain embodiments, the methods of screening for a Factor D inhibitor further comprise a step of quenching the activity of Factor D in the sample by providing an excessive amount of a quencher to the sample before the step of (c). When a control sample is used, in certain embodiments, the methods of screening for a Factor D inhibitor further comprise a step of quenching the activity of Factor D in the sample by providing an excessive amount of a quencher to the sample before the step of (c), and a step of quenching the activity of Factor D in the control sample by providing an excessive amount of the quencher to the control sample before the step of (g). In specific embodiments, the quencher is a Factor D inhibitor (for example, an anti-Factor D antibody or an excess amount of EDTA).

In certain embodiments, the anti-Factor Ba antibody is biotinylated, and the first moiety comprises streptavidin, avidin, or neutravidin. In some embodiments, the anti-Factor Ba antibody is biotinylated, and the first moiety comprises streptavidin. In certain embodiments, the anti-Factor Bb antibody is biotinylated, and the second moiety comprises streptavidin, avidin, or neutravidin. In some embodiments, the anti-Factor Bb antibody is biotinylated, and the second moiety comprises streptavidin.

In other various embodiments, the methods of screening for a Factor D inhibitor comprise: (a) mixing a Factor D inhibitor candidate with Factor D, Factor B and Factor C3b in a test reaction mix; (b) incubating the test reaction mix; (c) adding to the test reaction mix an anti-Factor C3b antibody labeled with a first moiety and an anti-Factor Ba antibody labeled with a second moiety after the step of (b), wherein one of the moieties is a donor, and the other is an acceptor, and wherein a proximity signal generated by the acceptor and/or the donor indicates that Factor C3b and Factor Ba are in proximity; and (d) measuring the value of the proximity signal from the test reaction mix; wherein the degree of Factor D activity inhibition by a Factor D candidate is positively correlated with the value of the proximity signal. In certain embodiments, the steps of (a)-(d) are carried out for each Factor D inhibitor candidate from the plurality.

In certain aspects of such other various embodiments, the methods of screening for a Factor D inhibitor further comprise: (e) mixing a control reaction mix; (f) incubating the control reaction mix; (g) adding to the control reaction mix the anti-Factor C3b antibody labeled with the first moiety and the anti-Factor Ba antibody labeled with the second moiety after the step of (f); and (h) measuring the value of the proximity signal from the control test reaction mix; wherein a greater value of the proximity signal from the test reaction mix relative to the control reaction mix (e.g., about 10%, 15%, 20%, 25%, 30%, 40%, 50%, 60%, 70%, 80%, 90% greater or more, or about 1-fold, 1.5-fold, 2-fold, 3-fold, 4-fold, 5-fold, 6-fold, 7-fold, 8-fold, 9-fold, 10-fold, 15-fold, 20-fold, 30-fold, 40-fold, 50-fold greater or more) indicates a greater inhibition of Factor D activity by the Factor D inhibitor candidate in the test reaction mix relative to the control reaction mix.

When the proximity signal generated by the donor and/or the acceptor is based on energy transfer between the donor and the acceptor upon light activation, in various embodiments, the methods of screening for a Factor D inhibitor comprise: (A) mixing a Factor D inhibitor candidate with Factor D, Factor B and Factor C3b in a test reaction mix; (B) incubating the test reaction mix; (C) adding to the test reaction mix an anti-Factor C3b antibody labeled with a first moiety and an anti-Factor Ba antibody labeled with a second moiety after the step of (B), wherein one of the moieties is a donor, and the other is an acceptor; (D) providing a light source to excite the donor in the test reaction mix; and (E) measuring the donor fluorescence emission intensity from the test reaction mix, and/or the acceptor fluorescence emission intensity from the test reaction mix; wherein the degree of Factor D activity inhibition by a Factor D candidate is negatively correlated with the donor fluorescence emission intensity from the test reaction mix, and/or is positively correlated with the acceptor fluorescence emission intensity from the test reaction mix. In specific embodiments, the step of (B) is conducted for about 15 min, 30 min, 45 min, 60 min, 75 min, or 90 min. In some embodiments, the step of (B) is conducted for about 45 min. In certain embodiments, the step of (E) is performed after a period of time of the step of (D) that results in a decrease in interfering short-lived background signals. In specific embodiments, the methods of screening for a Factor D inhibitor further comprise: (F) mixing a control reaction mix; (G) incubating the control reaction mix; (H) adding to the control reaction mix the anti-Factor C3b antibody labeled with the first moiety and the anti-Factor Ba antibody labeled with the second moiety after the step of (G); (I) providing said light source to excite the donor in the control reaction mix; and (J) measuring the donor fluorescence emission intensity from the control reaction mix, and/or the acceptor fluorescence emission intensity from the control reaction mix; wherein a lower donor fluorescence emission intensity from the test reaction mix relative to the control reaction mix, and/or a higher acceptor fluorescence emission intensity from the test reaction mix relative to the control reaction mix, indicates a greater inhibition of Factor D activity by the Factor D inhibitor candidate in the test reaction mix relative to the control reaction mix. In specific embodiments, the steps of (B) and (G) are conducted for about 15 min, 30 min, 45 min, 60 min, 75 min, or 90 min. In some embodiments, the steps of (B) and (G) are conducted for about 45 min. In certain embodiments, the step of (E) is performed after a period of time of the step of (d) that results in a decrease in interfering short-lived background signals, and the step of (J) is performed after the same period of time of the step of (I). In certain embodiments, the steps of (A)-(E) are carried out for each Factor D inhibitor candidate from the plurality.

In certain embodiments when anti-Factor C3b antibody and anti-Factor Ba antibody are used, the anti-Factor C3b antibody is biotinylated, and the first moiety comprises streptavidin, avidin, or neutravidin. In some embodiments, the anti-Factor C3b antibody is biotinylated, and the first moiety comprises streptavidin. In certain embodiments, the anti-Factor Ba antibody is biotinylated, and the second moiety comprises streptavidin, avidin, or neutravidin. In some embodiments, the anti-Factor Ba antibody is biotinylated, and the second moiety comprises streptavidin.

In certain embodiments when anti-Factor C3b antibody and anti-Factor Ba antibody are used, the anti-Factor C3b antibody and the anti-Factor Ba antibody used in the methods of screening for a Factor D inhibitor quench the activity of Factor D. In such embodiments, the need to add another quencher specifically is obviated. In certain embodiments when anti-Factor C3b antibody and anti-Factor Ba antibody are used, the methods of screening for a Factor D inhibitor further comprise a step of quenching the activity of Factor D in the sample by providing an excessive amount of a quencher to the sample before the step of (c). When a control sample is used, in certain embodiments, the methods of screening for a Factor D inhibitor further comprise a step of quenching the activity of Factor D in the sample by providing an excessive amount of a quencher to the sample before the step of (c), and a step of quenching the activity of Factor D in the control sample by providing an excessive amount of the quencher to the control sample before the step of (g). In specific embodiments, the quencher is a Factor D inhibitor (for example, an anti-Factor D antibody or an excess amount of EDTA).

The control reaction mix can comprise, for example, a different Factor D inhibitor with known potency (e.g., 100% potency) or no Factor D inhibitor, but contains everything else essentially the same as the test reaction mix. In specific embodiments, more than one control reaction mix is used in the methods described herein. In certain embodiments, a standard curve has been generated for screening for Factor D inhibitors without the need to measure a control reaction mix.

The donor/acceptor pair can be any known in the art, or as described in Section 5.1.

The Factor D inhibitor candidate can be any pharmaceutical agent that may reduce or block the activity of Factor D. In specific embodiments, the Factor D inhibitor candidate is an antibody or an antigen-binding fragment thereof, for example, an antibody or an antigen-binding fragment thereof that binds to Factor D. In specific embodiments, the antibody is a bispecific antibody. In specific embodiments, the Factor D inhibitor candidate is a small molecule inhibitor. In specific embodiments, the Factor D inhibitor candidate is a nucleotide (e.g., a DNA, an RNA, an shRNA, an miRNA, an siRNA, an antisense DNA). In specific embodiments, the Factor D inhibitor candidate is a peptide, a protein, a peptide mimetic, an aptamer, or any other molecule that binds to Factor D.

In the methods of screening for a Factor D inhibitor described above, the anti-Factor Ba, anti-Factor Bb, and/or anti-Factor C3b may be replaced by a peptide, a non-antibody protein, a peptide memetic, an aptamer, a nucleotide (e.g., DNA, RNA, shRNA, miRNA, siRNA, antisense DNA), or any other molecule that binds to Factor Ba, Factor Bb, or anti-Factor C3b, respectively. Alternatively, the Factor Ba, Factor Bb, and/or Factor C3b may be directed attached to the donor or acceptor (as the case may be) by direct chemical labeling.

In specific embodiments of the methods of screening for a Factor D inhibitor described herein, the Factor D is a recombinantly expressed Factor D. In specific embodiments of the methods of screening for a Factor D inhibitor described herein, the Factor D is endogenously expressed Factor D purified from a sample derived from a subject.

In specific embodiments of the methods of screening for a Factor D inhibitor described herein, the Factor B is a recombinantly expressed Factor B. In specific embodiments of the methods of screening for a Factor D inhibitor described herein, the Factor B is endogenously expressed Factor B purified from a sample derived from a subject.

The term "sample" referred to in the methods described herein, can be, but is not limited to, a blood sample or a serum sample.

The subject referred to in the methods described herein, can be, but is not limited to, a human or non-human vertebrate such as a wild, domestic or farm animal. In certain embodiments, the subject is a mammal, e.g., a human, a cow, a dog, a cat, a goat, a horse, a sheep, a pig, a rat, or a mouse. In a preferred embodiment, the subject is a human.

5.6. Kits

In another aspect, provided herein are kits for measuring Factor D activity, determining Factor D inhibitor potency, and/or screening for Factor D inhibitors. The kits described herein can be used in accordance with any methods described above as appropriate.

In various embodiments, the kits comprise an anti-Factor Ba antibody, an anti-Factor Bb antibody, a first moiety and a second moiety, wherein: (a) the anti-Factor Ba antibody is labeled or can be labeled with the first moiety, the anti-Factor Bb antibody is labeled or can be labeled with the second moiety; and (b) one of the moieties is a donor, and the other moiety is an acceptor. When using the kits, in specific embodiments a proximity signal can be generated by the donor and/or the acceptor, which indicates that the acceptor and the donor are in proximity.

When the proximity signal generated by the donor and/or the acceptor is based on energy transfer between the donor and the acceptor upon light activation, in various embodiments, the kits comprise an anti-Factor Ba antibody, an anti-Factor Bb antibody, a first moiety and a second moiety, wherein: (a) the anti-Factor Ba antibody is labeled or can be labeled with the first moiety, the anti-Factor Bb antibody is labeled or can be labeled with the second moiety; and (b) one of the moieties is a donor, and the other moiety is an acceptor. When using the kits, in specific embodiments upon excitation by a light source the ratio between the acceptor fluorescence emission intensity and the donor fluorescence emission intensity that is higher than a baseline level indicates that the donor and the acceptor are in proximity (a baseline level here is the ratio between the acceptor's fluorescence emission intensity and the donor's fluorescence emission intensity when the acceptor and the donor are apart (e.g., more than 10 nm, 20 nm, 50 nm, 100 nm, or 200 nm apart)).

In specific embodiments, the anti-Factor Ba antibody is biotinylated, and the first moiety comprises streptavidin, avidin, or neutravidin. In some embodiments, the anti-Factor Ba antibody is biotinylated, and the first moiety comprises streptavidin. In certain embodiments, the anti-Factor Bb antibody is biotinylated, and the second moiety comprises streptavidin, avidin, or neutravidin. In some embodiments, the anti-Factor Bb antibody is biotinylated, and the second moiety comprises streptavidin.

In specific embodiments, the anti-Factor Ba antibody and/or the anti-Factor Bb antibody is immobilized on a solid surface. In specific embodiments, the solid surface is a plate, a microplate, a chip, a membrane, or a bead.

In other various embodiments, the kits comprise an anti-Factor C3b antibody, an anti-Factor Ba antibody, a first moiety and a second moiety, wherein: (a) the anti-Factor C3b antibody is labeled or can be labeled with the first moiety, the anti-Factor Ba antibody is labeled or can be labeled with the second moiety; and (b) one of the moieties is a donor, and the other moiety is an acceptor. When using the kits, in specific embodiments a proximity signal can be generated by the donor and/or the acceptor, which indicates that the acceptor and the donor are in proximity.

When the proximity signal generated by the donor and/or the acceptor is based on energy transfer between the donor and the acceptor upon light activation, in various embodiments, the kits comprise an anti-Factor C3b antibody, an anti-Factor Ba antibody, a first moiety and a second moiety, wherein: (a) the anti-Factor C3b antibody is labeled or can be labeled with the first moiety, the anti-Factor Ba antibody is labeled or can be labeled with the second moiety; and (b) one of the moieties is a donor, and the other moiety is an acceptor. When using the kits, in specific embodiments upon excitation by a light source the ratio between the acceptor fluorescence emission intensity and the donor fluorescence emission intensity that is higher than a baseline level indicates that the donor and the acceptor are in proximity (a baseline level here is the ratio between the acceptor's fluorescence emission intensity and the donor's fluorescence emission intensity when the acceptor and the donor are apart (e.g., more than 10 nm, 20 nm, 50 nm, 100 nm, or 200 nm apart)).

In specific embodiments, the anti-Factor C3b antibody is biotinylated, and the first moiety comprises streptavidin, avidin, or neutravidin. In some embodiments, the anti-Factor C3b antibody is biotinylated, and the first moiety comprises streptavidin. In certain embodiments, the anti-Factor Ba antibody is biotinylated, and the second moiety comprises streptavidin, avidin, or neutravidin. In some embodiments, the anti-Factor Ba antibody is biotinylated, and the second moiety comprises streptavidin.

In specific embodiments, the anti-Factor C3b antibody and/or the anti-Factor Ba antibody is immobilized on a solid surface. In specific embodiments, the solid surface is a plate, a microplate, a chip, a membrane, or a bead.

In certain embodiments, the kits described herein further comprise a control sample with known Factor D activity.

In certain embodiments, the kits described herein further comprise a control Factor D inhibitor with known potency of inhibiting Factor D activity (e.g., 100% potency). In certain embodiments, the kits further comprise a control sample containing no Factor D inhibitor.

In certain embodiments, the kits described herein further comprise a quencher. In specific embodiments, the quencher is a Factor D inhibitor (for example, an anti-Factor D antibody or an excess amount of EDTA).

In specific embodiments, the kits further comprise a recombinantly expressed Factor B. In specific embodiments, the kits further comprise an endogenously expressed Factor B purified from a sample derived from a subject.

In specific embodiments, the kits further comprise a recombinantly expressed Factor D. In specific embodiments, the kits further comprise an endogenously expressed Factor D purified from a sample derived from a subject.

The term "sample" referred to in the kits described herein, can be, but is not limited to, a blood sample or a serum sample.

The subject referred to in the kits described herein, can be, but is not limited to, a human or non-human vertebrate such as a wild, domestic or farm animal. In certain embodiments, the subject is a mammal, e.g., a human, a cow, a dog, a cat, a goat, a horse, a sheep, a pig, a rat, or a mouse. In a preferred embodiment, the subject is a human.

The donor/acceptor pair can be any known in the art, or as described in Section 5.1

The individual components of the kits (e.g., anti-Factor Ba antibody, anti-Factor Bb antibody, first moiety, second moiety, quencher, control) can be packed in one or more containers. In some embodiments, each component is packed in its own container. In some embodiments when the kit comprises anti-Factor Ba antibody and anti-Factor Bb antibody, anti-Factor Ba antibody and the first moiety are packed in one container. In some embodiments when the kit comprises anti-Factor Ba antibody and anti-Factor Bb antibody, anti-Factor Bb antibody and the second moiety are packed in one container. In some embodiments when the kit comprises anti-Factor C3b antibody and anti-Factor Ba antibody, anti-Factor C3b antibody and the first moiety are packed in one container. In some embodiments when the kit comprises anti-Factor C3b antibody and anti-Factor Ba antibody, anti-Factor Ba antibody and the second moiety are packed in one container. The one or more containers can comprise bottle(s), vial(s), tube(s), plate(s), and/or microplate(s). In specific embodiments, the kits further comprise instructions for use of the kits.

6. EXAMPLE

This following non-limiting example demonstrates that proximity-based measurement assays are desirable methods to measure Factor D activity and Factor D inhibitor potency.

6.1. Introduction

Factor D activity has been identified as the key driver in the activation of the alternative complement pathway.

Lampalizumab is a Fab directed against the complement component Factor D (Katsche et al., 2012, J Biol Chem 287:12886-12892). Factor D is a highly specific chymotrypsin-like serine protease that is a rate-limiting enzyme in the activation of the complement alternative pathway (Katsche et al., 2012, J Biol Chem 287:12886-12892). The substrate for Factor D is another alternative complement pathway serine protease, Factor B. Factor C3b binds to Factor B; then, Factor D cleaves Factor B into Factor Ba and Factor Bb (Volanakis and Narayana, 1996, Protein Sci 5:553-564). Factor Bb remains bound to Factor C3b, forming the active C3 convertase, which initiates the alternative complement pathway. Increased activation of the alternative complement pathway has been found in drusen, cytotoxic deposits present on the Bruch's membrane, which are associated with the development of age-related macular degeneration (AMD) (Damico et al., 2012, Arq Bras Oftalmol 75:71-75).

Lampalizumab inhibits Factor D-mediated cleavage of Factor B, preventing alternative pathway activation, and thereby inhibiting inflammation and cytotoxic activity of the activated complement components (Tanhehco, 1999, Transplant Proc 31:2168-2171).

Activation of the alternative complement pathway is typically measured by adding human serum to rabbit erythrocytes. Next, intact erythrocytes and cellular debris are pelleted by centrifugation and lysis is determined by measuring the absorbance at 412 nm arising from the release of hemoglobin into the supernatant.

An alternative method was developed to measure Factor D enzymatic activity by measuring the cleavage of Factor B using Time Resolved-Förster Energy Resonance Transfer (i.e., fluorescence resonance energy transfer, FRET). The method was used to characterize the activity of a neutralizing Fab fragment directed against Factor D. This assay is simple, homogeneous and shows reproducible dose-response curves in the concentration range of 2 to 125 ng/mL. With interassay variability of less than 5% and recovery of 97-104%, this assay demonstrates acceptable precision and accuracy, and it is able to detect degradative changes in the anti-Factor D Fab fragment samples subjected to oxidative stress, suggesting that it is suitable for use as a potency method in quality control.

Strategies for assay development and optimization, as well as results from the characterization of the assay are presented below.

6.2. Materials and Methods

6.2.1. Materials

The following reagents were used for the FRET study: Lampalizumab, recombinant human Factor D and the anti-Factor Ba and anti-Factor Bb antibodies were generated at Genentech (South San Francisco, Calif.). Complement Factor B and Complement Factor C3b were purchased from Complement Technologies (Tyler, Tex.). Biotinylation of anti-Factor Bb was performed at Genentech using a kit purchased from Pierce (Rockland, Ill.). The Streptavidin-Alexa Fluor® 647 and custom conjugation of Complement Factor Ba to Europium were provided by Life Technologies (Grand Island, N.Y.).

The following reagents were used for the AlphaScreen® assay: the anti-Factor B antibodies, Complement Factors B, Factor C3b and Factor D, and the anti-Factor D antibody are as described above. The Streptavidin-coated donor beads and acceptor beads were purchased from Perkin Elmer (Waltham, Mass.).

The following reagents were used for the hemolysis assay: rabbit erythrocytes were purchased from Colorado Serum (Denver, Colo.). Veronal buffer and Gelatin were purchased from Lonza (Allendale, N.J.). C1q-depleted human serum was purchased from Quidel (San Diego, Calif.).

6.2.2. Factor B Cleavage Assay Procedure

FIG. 1 shows the assay schematic for the Lampalizumab TR-FRET (Time Resolved-FRET) assay. All reagents were prepared in Enzymatic Reaction Buffer (75 mM Sodium Chloride 1 mM Magnesium Chloride, 25 mM Tris, 0.005% Tween® 20 pH 7.3). Reference and sample Lampalizumab were titrated. Factor D was diluted to 12.5 ng/mL and Lampalizumab titrations were added 1:1 with the diluted Factor D. Complement Factor B and Complement Factor C3b were diluted to 1 μg/mL and 7 μg/mL, respectively, and combined 1:1. 50 μL per well of the Lampalizumab/Factor D mixture was added to a non-binding 96 well plate from Greiner (Monroe, N.C.) followed by 50 μL of the Factor B/Factor C3b mixture and the plate was incubated for 45 minutes with gentle agitation at 25C. Working concentrations of these reagents were determined by AlphaScreen® assay (data not shown). 50 μL of the detection mixture (1.2 μg/mL biotinylated anti-Factor Bb, 4.0 nM anti-Factor Ba-Europium and 25 nM Streptavidin-Alexa Fluor® 647) was added and the plate was incubated for 1 hour with gentle agitation at 25C. The Europium and Alexa Fluor® 647 fluorescence signals were measured on a Paradigm plate reader with an HTRF cartridge (Molecular Devices Sunnyvale, CA) with filters appropriate for the excitation of Europium (340 nm) and emission of the Europium and Alexa Fluor® 647 fluorophores (615 nm and 665 nm, respectively). The TR-FRET ratio was determined by dividing the fluorescence from the Alexa Fluor® 647 by the fluorescence of the Europium and multiplying by 10,000. The TR-FRET ratio of the Lampalizumab was plotted against the antibody concentrations using a 4 parameter curve-fitting program (Softmax® Pro, Molecular Devices, Sunnyvale, CA).

6.2.3. Hemolysis Assay Procedure

For determining alternative pathway activity, rabbit erythrocytes (Er) were washed 3 times in Gelatin Veronal Buffer (GVB) (0.1% gelatin in veronal buffer and resuspended to 2×109/ml). Lampalizumab (50 μl) and 20 μl of Er suspension were mixed 1:1 with GVB/0.1M EGTA/0.1M $MgCl_2$. Complement activation was initiated by the addition of C1q-depleted human serum (Quidel; 30 μl diluted 1:3 in GVB). After a 30 minute incubation at room temperature, 200 μl GVB/10 mM EDTA were added to stop the reaction and samples were centrifuged for 5 min at 500 g. Hemolysis was quantified in 200 μl supernatant by measuring absorbance at 412 nm. Data were expressed as % of hemolysis induced in the absence of the inhibitor.

Figure 2:
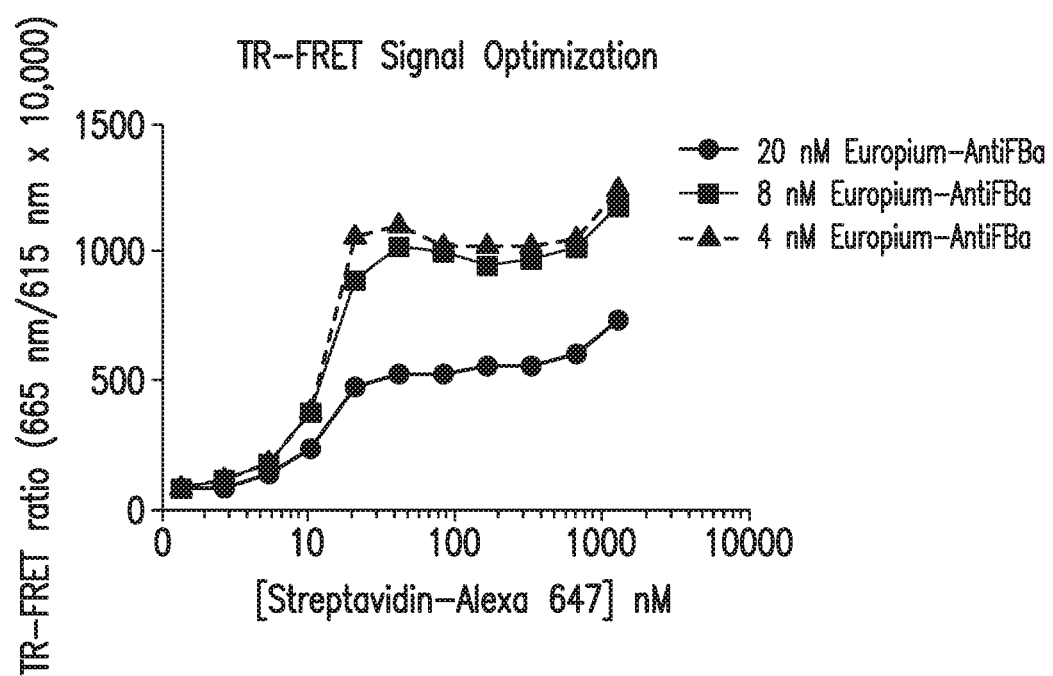
FIG. 2 depicts the co-titration of Streptavidin-Alexa Fluor® 647 conjugate and anti-Factor Ba-Europium. Varying concentrations of the Streptavidin-Alexa Fluor® 647 and anti-Factor Ba-Europium were analyzed with fixed concentrations of the other reagents and then the assay was performed as described in Section 6.1, in order to optimize the signal of the TR-FRET assay.

6.3. Results 6.3.1. Optimization of Conditions for Detection of Factor B Cleavage In order to optimize the signal of the TR-FRET assay, varying concentrations of the Streptavidin-Alexa Fluor® 647 and anti-Factor Ba-Europium were analyzed with fixed concentrations of the other reagents and then the assay was performed as described in Section 6.1. FIG. 2 shows this co-titration of Streptavidin-Alexa Fluor® 647 and anti-Factor Ba-Europium. Working concentrations of the Streptavidin-Alexa Fluor® 647 and anti-Factor Ba-Europium that provided optimal signal were 4.0 nM anti-Factor Ba-Europium and 25 nM Streptavidin-Alexa Fluor® 647, respectively.

Figure 3:
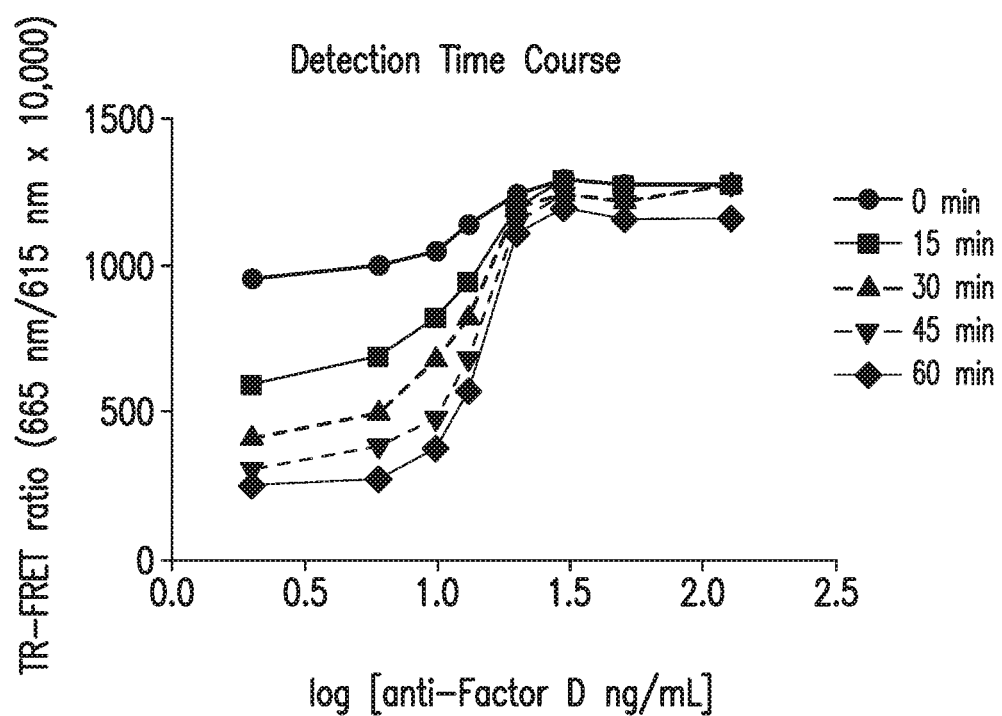
FIG. 3 depicts the TR-FRET ratios with different incubation times of the enzymatic reaction of the lampalizumab/ Factor D/Factor B/Factor C3b mixture. Note that the activity of Factor D was greatly diminished when the detection reagents were added prior to initiation of the enzymatic reaction (t=0) and increased with increasing time.

The anti-Factor Ba and anti-Factor Bb detection reagents were tested for their ability to inhibit the cleavage of Factor B by Factor D. FIG. 3 shows that the activity of Factor D was greatly diminished when the detection reagents were added from prior to initiation of the enzymatic reaction (t=0) and increased with increasing time. The small amount of activity seen in the t=0 is likely due to incomplete inactivation of Factor D by anti-Factor Ba and anti-Factor Bb and the extended amount of time required to conduct this experiment. The forty-five minute enzymatic incubation time was determined to provide suitable signal and robust method performance.

Figure 4:
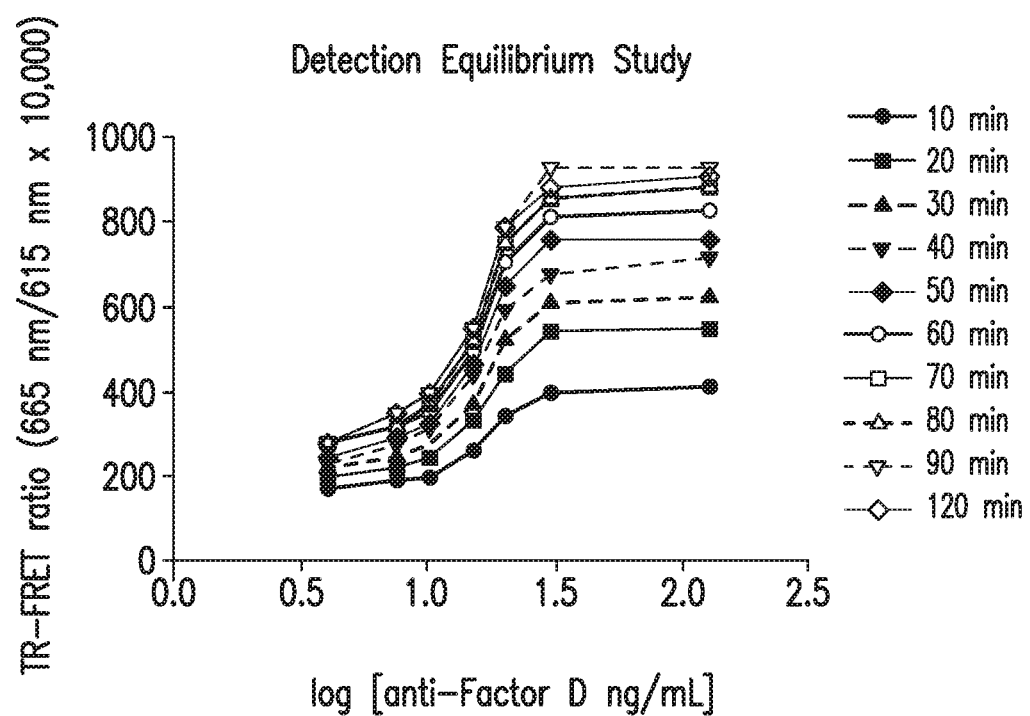
FIG. 4 depicts the TR-FRET ratios with different incubation times of the detection reagents (i.e., the mixture of anti-Factor Bb, anti-Factor Ba-Europium and Streptavidin-Alexa Fluor® 647).

Next, the incubation with detection reagents was optimized. The assay was run as described in Section 6.2, but the incubation with detection reagent was varied from 10-120 minutes. As seen in FIG. 4, a 60 minute detection reagent incubation provided suitable signal and robust method performance.

Figure 5A:
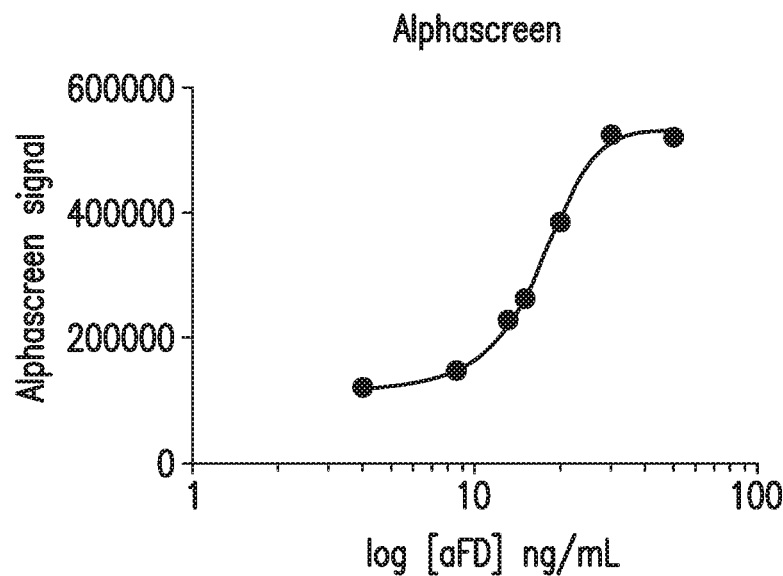
FIGS. 5A and 5B show that both the TR-FRET and the AlphaScreen® detection technologies generated good signal and dynamic range.
Figure 5B:
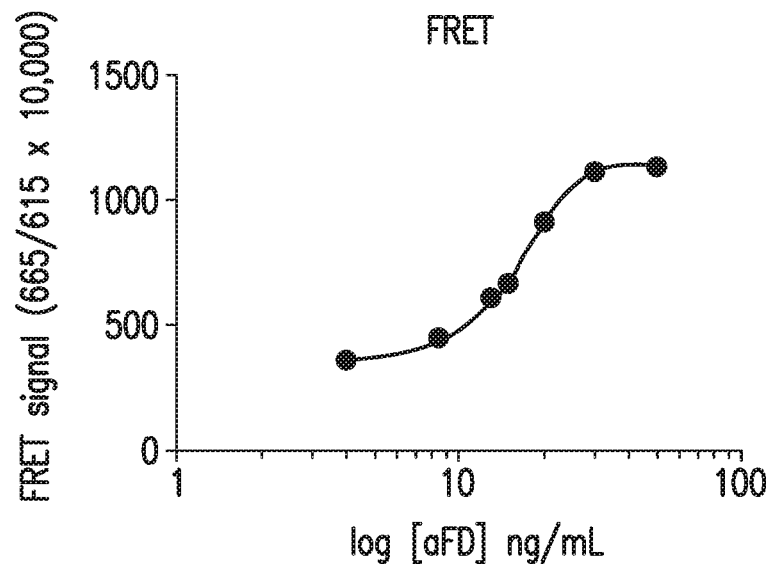

To demonstrate that it is possible to use alternate detection reagents to measure cleavage of Factor B, the assay was performed using AlphaScreen® reagents. Streptavidin-conjugated alpha donor beads and anti-Factor Ba-conjugated alpha acceptor beads were substituted for TR-FRET reagent. FIGS. 5A and 5B show that both detection technologies generated good signal and dynamic range.

6.3.2. Characterization of the anti-Factor D TR-FRET assay

Using the final assay format, we further characterized the assay by conducting a study for initial evaluation of accuracy and precision. Briefly, anti-Factor D was diluted to nominal concentrations of 0.3, 0.4, 0.5, 0.6 and 0.7 mg/mL, corresponding to 60, 80, 100 and 120 and 140% of the target concentration of 0.5 mg/mL, respectively. The protein concentrations of these dilutions were determined accurately by a UV spectrophotometric scan and determined to be 0.307, 0.381, 0.512, 0.597, 0.722 mg/mL. Each sample was subsequently diluted further into Enzymatic Reaction buffer and tested as described in Section 6.1. Each sample was assayed twelve times (6 times each by 2 different analysts) using new sample and reference dilutions for each assay.

To assess the accuracy of the assay, the measured activities were divided by the expected activities and expressed as percentage recoveries. Table 10 shows that mean activities of 60, 79, 100, 120 and 139% were obtained. This represents percentage recoveries ranging from 97-104%. Interassay variability, indicated by coefficient of variation (CV) was less than 5%.

These data strongly suggest that the assay is sensitive to differences in affinity

TABLE 10

Assessment of the accuracy of the Lampalizumab TR-FRET assay

| Expected activity (mg/mL) | Measure Activity (mg/mL) Mean +/− SD (n = 12) | Accuracy % | Interassay CV % |
|---|---|---|---|
| 0.307 | 0.300 +/− 0.0102 | 98 | 3 |
| 0.381 | 0.395 +/− 0.0096 | 104 | 3 |
| 0.512 | 0.500 +/− 0.0154 | 98 | 3 |
| 0.597 | 0.600 +/− 0.0259 | 101 | 5 |
| 0.722 | 0.695 +/− 0.0260 | 97 | 4 |

The ability of the Factor B cleavage assay to detect changes in activity of Lampalizumab samples subjected to stress was evaluated. Each sample was tested in 3 assays according to the method described above. The results are summarized in Table 11. Lampalizumab samples subjected to oxidation conditions (30 mM AAPH) exhibited a reduced activity of 63% compared to the control value of 93%.

TABLE 11

Assessment of the ability of the Lampalizumab TR-FRET assay to detect changes in activity of samples subjected to oxidiation stress

| Stressed Sample | TR-FRET Activity | Hemolytic Mean |
| --- | --- | --- |
| Unstressed control | 93 +/− 9 | 81 +/− 27 |
| Oxidized, 30 mM AAPH | 63 +/− 6 | 82 +/− 16 |
| Thermal Stress | 86 (1% diff) | 102 +/− 23 |
| Thermal control | 103 (0% diff) | 96 +/− 18 |

The activity of the stress samples was also measured using the rabbit erythrocyte lysis assay to compare the capability of the two methods. The data from this comparison are shown in Table 11 and demonstrate that the Factor B cleavage method is more precise and more sensitive to thermal and oxidative degradation.

6.4. Conclusion

The activity of Lampalizumab is dependent on its ability to bind to Factor D and inhibit its enzymatic activity. This type of activity can be measured in vitro by monitoring rabbit erythrocyte cell lysis after incubation with the Fab fragment. The TR-FRET assay described here measures the ability of Lampalizumab to bind to and inhibit the enzymatic activity of Factor D, the rate-limiting step in activation of the Alternate Complement pathway. To determine whether this method could serve as a suitable measure of Factor D activity, it was assessed for its ability to detect changes in the activity of Lampalizumab that was subjected to oxidative stress, and the data generated by this method were compared to data generated with a more established hemolytic method. The TR-FRET assay is capable of detecting losses in the activity of anti-Factor D subjected to oxidative stress. The results obtained using the TR-FRET assay reveal more sensitivity to stress than the hemolytic method, demonstrating that the TR-FRET assay is a suitable method to measure Factor D activity.

7. INCORPORATION BY REFERENCE

Various references such as patents, patent applications, and publications are cited herein, the disclosures of which are hereby incorporated by reference herein in their entireties.

SEQUENCE LISTING (916 sequences)

SEQ ID NO: 1 - protein, 10 aa, Artificial Sequence
  HVR-H1 sequence (in accordance with Kabat + Chothia) of anti-Factor D antibodies (Table 1)
GYTFTNYGMN

SEQ ID NO: 2 - protein, 17 aa, Artificial Sequence
  HVR-H2 sequence (in accordance with Kabat + Chothia) of anti-Factor D antibodies (Table 1)
WINTYTGETTYADDFKG

SEQ ID NO: 3 - protein, 17 aa, Artificial Sequence
  HVR-H2 sequence (in accordance with Kabat + Chothia) of anti-Factor D antibodies (Table 1)
WINTYTGETTYAEDFKG

SEQ ID NO: 4 - protein, 17 aa, Artificial Sequence
  HVR-H2 sequence (in accordance with Kabat + Chothia) of anti-Factor D antibodies (Table 1)
WISTYTGETTYAEDFKG

SEQ ID NO: 5 - protein, 6 aa, Artificial Sequence
  HVR-H3 sequence (in accordance with Kabat + Chothia) of anti-Factor D antibodies (Table 1)
EGGVNN

SEQ ID NO: 6 - protein, 6 aa, Artificial Sequence
  HVR-H3 sequence (in accordance with Kabat + Chothia) of anti-Factor D antibodies (Table 1)
EGGVDN

SEQ ID NO: 7 - protein, 6 aa, Artificial Sequence
  HVR-H3 sequence (in accordance with Kabat + Chothia) of anti-Factor D antibodies (Table 1)
EGGVQN

SEQ ID NO: 8 - protein, 6 aa, Artificial Sequence
  HVR-H3 sequence (in accordance with Kabat + Chothia) of anti-Factor D antibodies (Table 1)
EGGVSN

SEQ ID NO: 9 - protein, 11 aa, Artificial Sequence
  HVR-L1 sequence (in accordance with Kabat + Chothia) of anti-Factor D antibodies (Table 1)
ITSTDIDDDMN

SEQ ID NO: 10 - protein, 11 aa, Artificial Sequence
  HVR-L1 sequence (in accordance with Kabat + Chothia) of anti-Factor D antibodies (Table 1)
ITSTSIDDDMN

SEQ ID NO: 11 - protein, 11 aa, Artificial Sequence
  HVR-L1 sequence (in accordance with Kabat + Chothia) of anti-Factor D antibodies (Table 1)
ITSTDIEDDMN

SEQ ID NO: 12 - protein, 11 aa, Artificial Sequence
  HVR-L1 sequence (in accordance with Kabat + Chothia) of anti-Factor D antibodies (Table 1)
ITSTDIDSDMN

SEQ ID NO: 13 - protein, 11 aa, Artificial Sequence
  HVR-L1 sequence (in accordance with Kabat + Chothia) of anti-Factor D antibodies (Table 1)
ITSTDIDDSMN

SEQ ID NO: 14 - protein, 11 aa, Artificial Sequence
  HVR-L1 sequence (in accordance with Kabat + Chothia) of anti-Factor D antibodies (Table 1)
ITSTSIDSSMN

SEQ ID NO: 15 - protein, 11 aa, Artificial Sequence
  HVR-L1 sequence (in accordance with Kabat + Chothia) of anti-Factor D antibodies (Table 1)
ITSTDIESDMN

SEQ ID NO: 16 - protein, 11 aa, Artificial Sequence
  HVR-L1 sequence (in accordance with Kabat + Chothia) of anti-Factor D antibodies (Table 1)
ITSTSIESDMN

SEQ ID NO: 17 - protein, 11 aa, Artificial Sequence
  HVR-L1 sequence (in accordance with Kabat + Chothia) of anti-Factor D antibodies (Table 1)
ITSTSIESDMS

SEQ ID NO: 18 - protein, 7 aa, Artificial Sequence
  HVR-L2 sequence (in accordance with Kabat + Chothia) of anti-Factor D antibodies (Table 1)
GGNTLRP

SEQ ID NO: 19 - protein, 9 aa, Artificial Sequence
  HVR-L3 sequence (in accordance with Kabat + Chothia) of anti-Factor D antibodies (Table 1)
LQSDSLPYT

SEQ ID NO: 20 - protein, 9 aa, Artificial Sequence
  HVR-L3 sequence (in accordance with Kabat + Chothia) of anti-Factor D antibodies (Table 1)
LQSESLPYT

SEQ ID NO: 21 - protein, 115 aa, Artificial Sequence [sequence omitted]

SEQ ID NO: 22 - protein, 107 aa, Artificial Sequence [sequence omitted]

SEQ ID NO: 23 - protein, 115 aa, Artificial Sequence [sequence omitted]

SEQ ID NO: 24 - protein, 107 aa, Artificial Sequence
  AFD.v1 Light Chain Variable Region (Table 3)
DIQVTQSPSSLSASVGDRVTITCITSTSIDDDMNWYQQKPGKVPKLLISGGNTLRPGVPSRFSGSGSGTDFTLTISSLQPEDVATYYCLQSDSLPYTFGQGTKVEIK

SEQ ID NO: 25 - protein, 115 aa, Artificial Sequence [sequence omitted]

SEQ ID NO: 26 - protein, 107 aa, Artificial Sequence
  AFD.v2 Light Chain Variable Region (Table 3)
DIQVTQSPSSLSASVGDRVTITCITSTDIEDDMNWYQQKPGKVPKLLISGGNTLRPGVPSRFSGSGSGTDFTLTISSLQPEDVATYYCLQSDSLPYTFGQGTKVEIK

SEQ ID NO: 27 - protein, 115 aa, Artificial Sequence [sequence omitted]

SEQ ID NO: 28 - protein, 107 aa, Artificial Sequence
  AFD.v3 Light Chain Variable Region (Table 3)
DIQVTQSPSSLSASVGDRVTITCITSTDIDSDMNWYQQKPGKVPKLLISGGNTLRPGVPSRFSGSGSGTDFTLTISSLQPEDVATYYCLQSDSLPYTFGQGTKVEIK

SEQ ID NO: 29 - protein, 115 aa, Artificial Sequence [sequence omitted]

SEQ ID NO: 30 - protein, 107 aa, Artificial Sequence
  AFD.v4 Light Chain Variable Region (Table 3)
DIQVTQSPSSLSASVGDRVTITCITSTDIDDSMNWYQQKPGKVPKLLISGGNTLRPGVPSRFSGSGSGTDFTLTISSLQPEDVATYYCLQSDSLPYTFGQGTKVEIK

SEQ ID NO: 31 - protein, 115 aa, Artificial Sequence [sequence omitted]

SEQ ID NO: 32 - protein, 107 aa, Artificial Sequence
  AFD.v5 Light Chain Variable Region (Table 3)
DIQVTQSPSSLSASVGDRVTITCITSTSIDSSMNWYQQKPGKVPKLLISGGNTLRPGVPSRFSGSGSGTDFTLTISSLQPEDVATYYCLQSDSLPYTFGQGTKVEIK

SEQ ID NO: 33 - protein, 115 aa, Artificial Sequence
  AFD.v6 Heavy Chain Variable Region (Table 3)
EVQLVQSGPELKKPGASVKVSCKASGYTFTNYGMNWVRQAPGQGLEWMGWINTYTGETTYAEDFKGRFVFSLDTSVSTAYLQISSLKAEDTAVYYCEREGGVNNWGQGTLVTVSS

SEQ ID NO: 34 - protein, 107 aa, Artificial Sequence
  AFD.v6 Light Chain Variable Region (Table 3)
DIQVTQSPSSLSASVGDRVTITCITSTDIESDMNWYQQKPGKVPKLLISGGNTLRPGVPSRFSGSGSGTDFTLTISSLQPEDVATYYCLQSDSLPYTFGQGTKVEIK

SEQ ID NO: 35 - protein, 115 aa, Artificial Sequence; identical to SEQ ID NO: 33
  AFD.v7 Heavy Chain Variable Region (Table 3)

SEQ ID NO: 36 - protein, 107 aa, Artificial Sequence
  AFD.v7 Light Chain Variable Region (Table 3)
DIQVTQSPSSLSASVGDRVTITCITSTDIESDMNWYQQKPGKVPKLLISGGNTLRPGVPSRFSGSGSGTDFTLTISSLQPEDVATYYCLQSESLPYTFGQGTKVEIK

SEQ ID NO: 37 - protein, 115 aa, Artificial Sequence; identical to SEQ ID NO: 33
  AFD.v8 Heavy Chain Variable Region (Table 3)

SEQ ID NO: 38 - protein, 107 aa, Artificial Sequence
  AFD.v8 Light Chain Variable Region (Table 3)
DIQVTQSPSSLSASVGDRVTITCITSTSIESDMNWYQQKPGKVPKLLISGGNTLRPGVPSRFSGSGSGTDFTLTISSLQPEDVATYYCLQSDSLPYTFGQGTKVEIK

SEQ ID NO: 39 - protein, 115 aa, Artificial Sequence; identical to SEQ ID NO: 33
  AFD.v9 Heavy Chain Variable Region (Table 3)

SEQ ID NO: 40 - protein, 107 aa, Artificial Sequence
  AFD.v9 Light Chain Variable Region (Table 3)
DIQVTQSPSSLSASVGDRVTITCITSTSIESDMSWYQQKPGKVPKLLISGGNTLRPGVPSRFSGSGSGTDFTLTISSLQPEDVATYYCLQSDSLPYTFGQGTKVEIK

SEQ ID NO: 41 - protein, 115 aa, Artificial Sequence; identical to SEQ ID NO: 33
  AFD.v10 Heavy Chain Variable Region (Table 3)

SEQ ID NO: 42 - protein, 107 aa, Artificial Sequence
  AFD.v10 Light Chain Variable Region (Table 3)
DIQVTQSPSSLSASVGDRVTITCITSTSIESDMNWYQQKPGKVPKLLISGGNTLRPGVPSRFSGSGSGTDFTLTISSLQPEDVATYYCLQSESLPYTFGQGTKVEIK

SEQ ID NO: 43 - protein, 115 aa, Artificial Sequence
  AFD.v11 Heavy Chain Variable Region (Table 3)
EVQLVQSGPELKKPGASVKVSCKASGYTFTNYGMNWVRQAPGQGLEWMGWISTYTGETTYAEDFKGRFVFSLDTSVSTAYLQISSLKAEDTAVYYCEREGGVNNWGQGTLVTVSS

SEQ ID NO: 44 - protein, 107 aa, Artificial Sequence; identical to SEQ ID NO: 38
  AFD.v11 Light Chain Variable Region (Table 3)

SEQ ID NO: 45 - protein, 115 aa, Artificial Sequence
  AFD.v12 Heavy Chain Variable Region (Table 3)
EVQLVQSGPELKKPGASVKVSCKASGYTFTNYGMNWVRQAPGQGLEWMGWINTYTGETTYAEDFKGRFVFSLDTSVSTAYLQISSLKAEDTAVYYCEREGGVDNWGQGTLVTVSS

SEQ ID NO: 46 - protein, 107 aa, Artificial Sequence; identical to SEQ ID NO: 38
  AFD.v12 Light Chain Variable Region (Table 3)

SEQ ID NO: 47 - protein, 115 aa, Artificial Sequence
  AFD.v13 Heavy Chain Variable Region (Table 3)
EVQLVQSGPELKKPGASVKVSCKASGYTFTNYGMNWVRQAPGQGLEWMGWINTYTGETTYAEDFKGRFVFSLDTSVSTAYLQISSLKAEDTAVYYCEREGGVQNWGQGTLVTVSS

SEQ ID NO: 48 - protein, 107 aa, Artificial Sequence; identical to SEQ ID NO: 38
  AFD.v13 Light Chain Variable Region (Table 3)

SEQ ID NO: 49 - protein, 115 aa, Artificial Sequence
  AFD.v14 Heavy Chain Variable Region (Table 3)
EVQLVQSGPELKKPGASVKVSCKASGYTFTNYGMNWVRQAPGQGLEWMGWINTYTGETTYAEDFKGRFVFSLDTSVSTAYLQISSLKAEDTAVYYCEREGGVSNWGQGTLVTVSS

SEQ ID NO: 50 - protein, 107 aa, Artificial Sequence; identical to SEQ ID NO: 38
  AFD.v14 Light Chain Variable Region (Table 3)

SEQ ID NO: 51 - protein, 115 aa, Artificial Sequence; identical to SEQ ID NO: 49
  AFD.v15 Heavy Chain Variable Region (Table 3)

SEQ ID NO: 52 - protein, 107 aa, Artificial Sequence; identical to SEQ ID NO: 42
  AFD.v15 Light Chain Variable Region (Table 3)

SEQ ID NO: 53 - protein, 223 aa, Artificial Sequence
  AFD-WT Heavy Chain (Table 5)
EVQLVQSGPELKKPGASVKVSCKASGYTFTNYGMNWVRQAPGQGLEWMGWINTYTGETTYADDFKGRFVFSLDTSVSTAYLQISSLKAEDTAVYYCEREGGVNNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHT

SEQ ID NO: 54 - protein, 214 aa, Artificial Sequence
  AFD-WT Light Chain (Table 5)
DIQVTQSPSSLSASVGDRVTITCITSTDIDDDMNWYQQKPGKVPKLLISGGNTLRPGVPSRFSGSGSGTDFTLTISSLQPEDVATYYCLQSDSLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 55 - protein, 223 aa, Artificial Sequence; identical to SEQ ID NO: 53
  AFD.v1 Heavy Chain (Table 5)

SEQ ID NO: 56 - protein, 214 aa, Artificial Sequence
  AFD.v1 Light Chain (Table 5)
DIQVTQSPSSLSASVGDRVTITCITSTSIDDDMNWYQQKPGKVPKLLISGGNTLRPGVPSRFSGSGSGTDFTLTISSLQPEDVATYYCLQSDSLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 57 - protein, 223 aa, Artificial Sequence; identical to SEQ ID NO: 53
  AFD.v2 Heavy Chain (Table 5)

SEQ ID NO: 58 - protein, 214 aa, Artificial Sequence
  AFD.v2 Light Chain (Table 5)
DIQVTQSPSSLSASVGDRVTITCITSTDIEDDMNWYQQKPGKVPKLLISGGNTLRPGVPSRFSGSGSGTDFTLTISSLQPEDVATYYCLQSDSLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 59 - protein, 223 aa, Artificial Sequence; identical to SEQ ID NO: 53
  AFD.v3 Heavy Chain (Table 5)

SEQ ID NO: 60 - protein, 214 aa, Artificial Sequence
  AFD.v3 Light Chain (Table 5)
DIQVTQSPSSLSASVGDRVTITCITSTDIDSDMNWYQQKPGKVPKLLISGGNTLRPGVPSRFSGSGSGTDFTLTISSLQPEDVATYYCLQSDSLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 61 - protein, 223 aa, Artificial Sequence; identical to SEQ ID NO: 53
  AFD.v4 Heavy Chain (Table 5)

SEQ ID NO: 62 - protein, 214 aa, Artificial Sequence
  AFD.v4 Light Chain (Table 5)
DIQVTQSPSSLSASVGDRVTITCITSTDIDDSMNWYQQKPGKVPKLLISGGNTLRPGVPSRFSGSGSGTDFTLTISSLQPEDVATYYCLQSDSLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 63 - protein, 223 aa, Artificial Sequence; identical to SEQ ID NO: 53
  AFD.v5 Heavy Chain (Table 5)

SEQ ID NO: 64 - protein, 214 aa, Artificial Sequence
  AFD.v5 Light Chain (Table 5)
DIQVTQSPSSLSASVGDRVTITCITSTSIDSSMNWYQQKPGKVPKLLISGGNTLRPGVPSRFSGSGSGTDFTLTISSLQPEDVATYYCLQSDSLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 65 - protein, 223 aa, Artificial Sequence
  AFD.v6 Heavy Chain (Table 5)
EVQLVQSGPELKKPGASVKVSCKASGYTFTNYGMNWVRQAPGQGLEWMGWINTYTGETTYAEDFKGRFVFSLDTSVSTAYLQISSLKAEDTAVYYCEREGGVNNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHT

SEQ ID NO: 66 - protein, 214 aa, Artificial Sequence
  AFD.v6 Light Chain (Table 5)
DIQVTQSPSSLSASVGDRVTITCITSTDIESDMNWYQQKPGKVPKLLISGGNTLRPGVPSRFSGSGSGTDFTLTISSLQPEDVATYYCLQSDSLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 67 - protein, 223 aa, Artificial Sequence; identical to SEQ ID NO: 65
  AFD.v7 Heavy Chain (Table 5)

SEQ ID NO: 68 - protein, 214 aa, Artificial Sequence
  AFD.v7 Light Chain (Table 5)
DIQVTQSPSSLSASVGDRVTITCITSTDIESDMNWYQQKPGKVPKLLISGGNTLRPGVPSRFSGSGSGTDFTLTISSLQPEDVATYYCLQSESLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 69 - protein, 223 aa, Artificial Sequence; identical to SEQ ID NO: 65
  AFD.v8 Heavy Chain (Table 5)

SEQ ID NO: 70 - protein, 214 aa, Artificial Sequence
  AFD.v8 Light Chain (Table 5)
DIQVTQSPSSLSASVGDRVTITCITSTSIESDMNWYQQKPGKVPKLLISGGNTLRPGVPSRFSGSGSGTDFTLTISSLQPEDVATYYCLQSDSLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 71 - protein, 223 aa, Artificial Sequence; identical to SEQ ID NO: 65
  AFD.v9 Heavy Chain (Table 5)

SEQ ID NO: 72 - protein, 214 aa, Artificial Sequence
  AFD.v9 Light Chain (Table 5)
DIQVTQSPSSLSASVGDRVTITCITSTSIESDMSWYQQKPGKVPKLLISGGNTLRPGVPSRFSGSGSGTDFTLTISSLQPEDVATYYCLQSDSLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 73 - protein, 223 aa, Artificial Sequence; identical to SEQ ID NO: 65
  AFD.v10 Heavy Chain (Table 5)

SEQ ID NO: 74 - protein, 214 aa, Artificial Sequence
  AFD.v10 Light Chain (Table 5)
DIQVTQSPSSLSASVGDRVTITCITSTSIESDMNWYQQKPGKVPKLLISGGNTLRPGVPSRFSGSGSGTDFTLTISSLQPEDVATYYCLQSESLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 75 - protein, 223 aa, Artificial Sequence
  AFD.v11 Heavy Chain (Table 5)
EVQLVQSGPELKKPGASVKVSCKASGYTFTNYGMNWVRQAPGQGLEWMGWISTYTGETTYAEDFKGRFVFSLDTSVSTAYLQISSLKAEDTAVYYCEREGGVNNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHT

SEQ ID NO: 76 - protein, 214 aa, Artificial Sequence; identical to SEQ ID NO: 70
  AFD.v11 Light Chain (Table 5)

SEQ ID NO: 77 - protein, 223 aa, Artificial Sequence
  AFD.v12 Heavy Chain (Table 5)
EVQLVQSGPELKKPGASVKVSCKASGYTFTNYGMNWVRQAPGQGLEWMGWINTYTGETTYAEDFKGRFVFSLDTSVSTAYLQISSLKAEDTAVYYCEREGGVDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHT

SEQ ID NO: 78 - protein, 214 aa, Artificial Sequence; identical to SEQ ID NO: 70
  AFD.v12 Light Chain (Table 5)

SEQ ID NO: 79 - protein, 223 aa, Artificial Sequence
  AFD.v13 Heavy Chain (Table 5)
EVQLVQSGPELKKPGASVKVSCKASGYTFTNYGMNWVRQAPGQGLEWMGWINTYTGETTYAEDFKGRFVFSLDTSVSTAYLQISSLKAEDTAVYYCEREGGVQNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHT

SEQ ID NO: 80 - protein, 214 aa, Artificial Sequence; identical to SEQ ID NO: 70
  AFD.v13 Light Chain (Table 5)

SEQ ID NO: 81 - protein, 223 aa, Artificial Sequence
  AFD.v14 Heavy Chain (Table 5)
EVQLVQSGPELKKPGASVKVSCKASGYTFTNYGMNWVRQAPGQGLEWMGWINTYTGETTYAEDFKGRFVFSLDTSVSTAYLQISSLKAEDTAVYYCEREGGVSNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHT

SEQ ID NO: 82 - protein, 214 aa, Artificial Sequence; identical to SEQ ID NO: 70
  AFD.v14 Light Chain (Table 5)

SEQ ID NO: 83 - protein, 223 aa, Artificial Sequence; identical to SEQ ID NO: 81
  AFD.v15 Heavy Chain (Table 5)

SEQ ID NO: 84 - protein, 214 aa, Artificial Sequence; identical to SEQ ID NO: 74
  AFD.v15 Light Chain (Table 5)

SEQ ID NO: 85 - protein, 5 aa, Artificial Sequence
  HVR-H1 sequence (in accordance with Kabat + Chothia) of anti-Factor D antibodies (Table 2)
SYYMY

SEQ ID NO: 86 - protein, 17 aa, Artificial Sequence
  HVR-H2 sequence (in accordance with Kabat + Chothia) of anti-Factor D antibodies (Table 2)
EINPTNGGTNFNEKFKS

SEQ ID NO: 87 - protein, 17 aa, Artificial Sequence
  HVR-H2 sequence (in accordance with Kabat + Chothia) of anti-Factor D antibodies (Table 2)
EINPTSGGTNFNEKFKS

SEQ ID NO: 88 - protein, 17 aa, Artificial Sequence
  HVR-H2 sequence (in accordance with Kabat + Chothia) of anti-Factor D antibodies (Table 2)
EINPYSGDTNFNEKFKS

SEQ ID NO: 89 - protein, 17 aa, Artificial Sequence
  HVR-H2 sequence (in accordance with Kabat + Chothia) of anti-Factor D antibodies (Table 2)
EINPTQGGTNFNEKFKS

SEQ ID NO: 90 - protein, 17 aa, Artificial Sequence
  HVR-H2 sequence (in accordance with Kabat + Chothia) of anti-Factor D antibodies (Table 2)
EINPTSGDTNFNEKFKS

SEQ ID NO: 91 - protein, 17 aa, Artificial Sequence
  HVR-H2 sequence (in accordance with Kabat + Chothia) of anti-Factor D antibodies (Table 2)
EINPTSGETNFNEKFKS

SEQ ID NO: 92 - protein, 17 aa, Artificial Sequence
  HVR-H2 sequence (in accordance with Kabat + Chothia) of anti-Factor D antibodies (Table 2)
EINPYSGGTNFNEKFKS

SEQ ID NO: 93 - protein, 17 aa, Artificial Sequence
  HVR-H2 sequence (in accordance with Kabat + Chothia) of anti-Factor D antibodies (Table 2)
WINPTSGGTNFNEKFKS

SEQ ID NO: 94 - protein, 17 aa, Artificial Sequence
  HVR-H2 sequence (in accordance with Kabat + Chothia) of anti-Factor D antibodies (Table 2)
EINPYSGETNFNEKFKS

SEQ ID NO: 95 - protein, 6 aa, Artificial Sequence
  HVR-H3 sequence (in accordance with Kabat + Chothia) of anti-Factor D antibodies (Table 2)
EGGFAY

SEQ ID NO: 96 - protein, 11 aa, Artificial Sequence
  HVR-L1 sequence (in accordance with Kabat + Chothia) of anti-Factor D antibodies (Table 2)
KASQNVDTDVA

SEQ ID NO: 97 - protein, 7 aa, Artificial Sequence
  HVR-L2 sequence (in accordance with Kabat + Chothia) of anti-Factor D antibodies (Table 2)
SASSRYS

SEQ ID NO: 98 - protein, 7 aa, Artificial Sequence
  HVR-L2 sequence (in accordance with Kabat + Chothia) of anti-Factor D antibodies (Table 2)
SASSRKS

SEQ ID NO: 99 - protein, 7 aa, Artificial Sequence
  HVR-L2 sequence (in accordance with Kabat + Chothia) of anti-Factor D antibodies (Table 2)
SASSRRS

SEQ ID NO: 100 - protein, 9 aa, Artificial Sequence
  HVR-L3 sequence (in accordance with Kabat + Chothia) of anti-Factor D antibodies (Table 2)
QQYNNYPLT

SEQ ID NO: 101 - protein, 9 aa, Artificial Sequence
  HVR-L3 sequence (in accordance with Kabat + Chothia) of anti-Factor D antibodies (Table 2)
QQYENYPLT

SEQ ID NO: 102 - protein, 115 aa, Artificial Sequence
  anti-Factor D antibody Heavy Chain Variable Region (Table 4)
QVQLQQSGAELVKPGASVKLSCKASGYTFTSYYMYWVKERPGQGLEWIGEINPTNGGTNFNEKFKSKATLTVDTSSNTAYMQLSSLTSEDSAVYYCAREGGFAYWGQGTLVTVSA

SEQ ID NO: 103 - protein, 107 aa, Artificial Sequence
  anti-Factor D antibody Light Chain Variable Region (Table 4)
DIVMTQSQKFMSTSVGDRVSVTCKASQNVDTDVAWFQQKPGQSPRGLIYSASSRYSGVPDRFTGSGSGTDFTLTISNVQSEDLAEYFCQQYNNYPLTFGSGTKVEIK

SEQ ID NO: 104 - protein, 115 aa, Artificial Sequence
  huAFD.v2.0 Heavy Chain Variable Region (Table 4)
EVQLVQSGAEVKKPGASVKVSCKASGYTFTSYYMYWVRQAPGQGLEWIGEINPTSGGTNFNEKFKSRATLTVDTSTSTAYLELSSLRSEDTAVYYCAREGGFAYWGQGTLVTVSS

SEQ ID NO: 105 - protein, 107 aa, Artificial Sequence
  huAFD.v2.0 Light Chain Variable Region (Table 4)
DIQMTQSPSSLSASVGDRVTITCKASQNVDTDVAWFQQKPGKAPKGLIYSASSRYSGVPSRFSGSGSGTDFTLTISSLQPEDFATYYCQQYNNYPLTFGQGTKVEIK

SEQ ID NO: 106 - protein, 115 aa, Artificial Sequence; identical to SEQ ID NO: 104
  huAFD.v2.1 Heavy Chain Variable Region (Table 4)

SEQ ID NO: 107 - protein, 107 aa, Artificial Sequence
  huAFD.v2.1 Light Chain Variable Region (Table 4)
DIQMTQSPSSLSASVGDRVTITCKASQNVDTDVAWFQQKPGKAPKGLIRSASSRYSGVPSRFSGSGSGTDFTLTISSLQPEDFATYYCQQYNNYPLTFGQGTKVEIK

SEQ ID NO: 108 - protein, 115 aa, Artificial Sequence
  huAFD.v2.3 Heavy Chain Variable Region (Table 4)
EVQLVQSGAEVKKPGASVKVSCKASGYTFTSYYMYWVRQAPGQGLEWIGEINPYSGDTNFNEKFKSRATLTVDTSTSTAYLELSSLRSEDTAVYYCAREGGFAYWGQGTLVTVSS

SEQ ID NO: 109 - protein, 107 aa, Artificial Sequence; identical to SEQ ID NO: 107
  huAFD.v2.3 Light Chain Variable Region (Table 4)

SEQ ID NO: 110 - protein, 115 aa, Artificial Sequence
  huAFD.v1 Heavy Chain Variable Region (Table 4)
EVQLVQSGAEVKKPGASVKVSCKASGYTFTSYYMYWVRQAPGQGLEWIGEINPTNGGTNFNEKFKSRATLTVDTSTSTAYLELSSLRSEDTAVYYCAREGGFAYWGQGTLVTVSS

SEQ ID NO: 111 - protein, 107 aa, Artificial Sequence; identical to SEQ ID NO: 105
  huAFD.v1 Light Chain Variable Region (Table 4)

SEQ ID NO: 112 - protein, 115 aa, Artificial Sequence
  huAFD.v1.1 Heavy Chain Variable Region (Table 4)
EVQLVQSGAEVKKPGASVKVSCKASGYTFTSYYMYWVRQAPGQGLEWIGEINPTQGGTNFNEKFKSRATLTVDTSTSTAYLELSSLRSEDTAVYYCAREGGFAYWGQGTLVTVSS

SEQ ID NO: 113 - protein, 107 aa, Artificial Sequence; identical to SEQ ID NO: 105
  huAFD.v1.1 Light Chain Variable Region (Table 4)

SEQ ID NO: 114 - protein, 115 aa, Artificial Sequence
  huAFD.v2.2 Heavy Chain Variable Region (Table 4)
EVQLVQSGAEVKKPGASVKVSCKASGYTFTSYYMYWVRQAPGQGLEWIGEINPTSGDTNFNEKFKSRATLTVDTSTSTAYLELSSLRSEDTAVYYCAREGGFAYWGQGTLVTVSS

SEQ ID NO: 115 - protein, 107 aa, Artificial Sequence; identical to SEQ ID NO: 105
  huAFD.v2.2 Light Chain Variable Region (Table 4)

SEQ ID NO: 116 - protein, 115 aa, Artificial Sequence
  huAFD.v2.4 Heavy Chain Variable Region (Table 4)
EVQLVQSGAEVKKPGASVKVSCKASGYTFTSYYMYWVRQAPGQGLEWIGEINPTSGETNFNEKFKSRATLTVDTSTSTAYLELSSLRSEDTAVYYCAREGGFAYWGQGTLVTVSS

SEQ ID NO: 117 - protein, 107 aa, Artificial Sequence; identical to SEQ ID NO: 105
  huAFD.v2.4 Light Chain Variable Region (Table 4)

SEQ ID NO: 118 - protein, 115 aa, Artificial Sequence
  huAFD.v2.5 Heavy Chain Variable Region (Table 4)
EVQLVQSGAEVKKPGASVKVSCKASGYTFTSYYMYWVRQAPGQGLEWIGEINPYSGGTNFNEKFKSRATLTVDTSTSTAYLELSSLRSEDTAVYYCAREGGFAYWGQGTLVTVSS

SEQ ID NO: 119 - protein, 107 aa, Artificial Sequence; identical to SEQ ID NO: 105
  huAFD.v2.5 Light Chain Variable Region (Table 4)

SEQ ID NO: 120 - protein, 115 aa, Artificial Sequence; identical to SEQ ID NO: 104
  huAFD.v2.6 Heavy Chain Variable Region (Table 4)

SEQ ID NO: 121 - protein, 107 aa, Artificial Sequence
  huAFD.v2.6 Light Chain Variable Region (Table 4)
DIQMTQSPSSLSASVGDRVTITCKASQNVDTDVAWFQQKPGKAPKGLISSASSRYSGVPSRFSGSGSGTDFTLTISSLQPEDFATYYCQQYNNYPLTFGQGTKVEIK

SEQ ID NO: 122 - protein, 115 aa, Artificial Sequence; identical to SEQ ID NO: 104
  huAFD.v2.7 Heavy Chain Variable Region (Table 4)

SEQ ID NO: 123 - protein, 107 aa, Artificial Sequence
  huAFD.v2.7 Light Chain Variable Region (Table 4)
DIQMTQSPSSLSASVGDRVTITCKASQNVDTDVAWFQQKPGKAPKGLIKSASSRYSGVPSRFSGSGSGTDFTLTISSLQPEDFATYYCQQYNNYPLTFGQGTKVEIK

SEQ ID NO: 124 - protein, 115 aa, Artificial Sequence; identical to SEQ ID NO: 104
  huAFD.v2.8 Heavy Chain Variable Region (Table 4)

SEQ ID NO: 125 - protein, 107 aa, Artificial Sequence
  huAFD.v2.8 Light Chain Variable Region (Table 4)
DIQMTQSPSSLSASVGDRVTITCKASQNVDTDVAWFQQKPGKAPKGLIQSASSRYSGVPSRFSGSGSGTDFTLTISSLQPEDFATYYCQQYNNYPLTFGQGTKVEIK

SEQ ID NO: 126 - protein, 115 aa, Artificial Sequence
  huAFD.v2.9 Heavy Chain Variable Region (Table 4)
EVQLVQSGAEVKKPGASVKVSCKASGYTFTSYYMYWVRQAPGQGLEWIGWINPTSGGTNFNEKFKSRATLTVDTSTSTAYLELSSLRSEDTAVYYCAREGGFAYWGQGTLVTVSS

SEQ ID NO: 127 - protein, 107 aa, Artificial Sequence; identical to SEQ ID NO: 105
  huAFD.v2.9 Light Chain Variable Region (Table 4)

SEQ ID NO: 128 - protein, 115 aa, Artificial Sequence; identical to SEQ ID NO: 104
  huAFD.v2.10 Heavy Chain Variable Region (Table 4)

SEQ ID NO: 129 - protein, 107 aa, Artificial Sequence
  huAFD.v2.10 Light Chain Variable Region (Table 4)
DIQMTQSPSSLSASVGDRVTITCKASQNVDTDVAWFQQKPGKAPKGLIYSASSRKSGVPSRFSGSGSGTDFTLTISSLQPEDFATYYCQQYNNYPLTFGQGTKVEIK

SEQ ID NO: 130 - protein, 115 aa, Artificial Sequence; identical to SEQ ID NO: 104
  huAFD.v2.11 Heavy Chain Variable Region (Table 4)

SEQ ID NO: 131 - protein, 107 aa, Artificial Sequence
  huAFD.v2.11 Light Chain Variable Region (Table 4)
DIQMTQSPSSLSASVGDRVTITCKASQNVDTDVAWFQQKPGKAPKGLIYSASSRRSGVPSRFSGSGSGTDFTLTISSLQPEDFATYYCQQYNNYPLTFGQGTKVEIK

SEQ ID NO: 132 - protein, 115 aa, Artificial Sequence; identical to SEQ ID NO: 118
  huAFD.v2.12 Heavy Chain Variable Region (Table 4)

SEQ ID NO: 133 - protein, 107 aa, Artificial Sequence; identical to SEQ ID NO: 107
  huAFD.v2.12 Light Chain Variable Region (Table 4)

SEQ ID NO: 134 - protein, 115 aa, Artificial Sequence; identical to SEQ ID NO: 104
  huAFD.v2.13 Heavy Chain Variable Region (Table 4)

SEQ ID NO: 135 - protein, 107 aa, Artificial Sequence
  huAFD.v2.13 Light Chain Variable Region (Table 4)
DIQMTQSPSSLSASVGDRVTITCKASQNVDTDVAWFQQKPGKAPKGLIRSASSRYSGVPSRFSGSGSGTDFTLTISSLQPEDFATYYCQQYENYPLTFGQGTKVEIK

SEQ ID NO: 136 - protein, 115 aa, Artificial Sequence; identical to SEQ ID NO: 116
  huAFD.v2.14 Heavy Chain Variable Region (Table 4)

SEQ ID NO: 137 - protein, 107 aa, Artificial Sequence; identical to SEQ ID NO: 107
  huAFD.v2.14 Light Chain Variable Region (Table 4)

SEQ ID NO: 138 - protein, 115 aa, Artificial Sequence
  huAFD.v2.15 Heavy Chain Variable Region (Table 4)
EVQLVQSGAEVKKPGASVKVSCKASGYTFTSYYMYWVRQAPGQGLEWIGEINPYSGETNFNEKFKSRATLTVDTSTSTAYLELSSLRSEDTAVYYCAREGGFAYWGQGTLVTVSS

SEQ ID NO: 139 - protein, 107 aa, Artificial Sequence; identical to SEQ ID NO: 107
  huAFD.v2.15 Light Chain Variable Region (Table 4)

SEQ ID NO: 140 - protein, 223 aa, Artificial Sequence
  huAFD.v2.0 Heavy Chain (Table 6)
EVQLVQSGAEVKKPGASVKVSCKASGYTFTSYYMYWVRQAPGQGLEWIGEINPTSGGTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHT

SEQ ID NO: 141 - protein, 214 aa, Artificial Sequence
  huAFD.v2.0 Light Chain (Table 6)
DIQMTQSPSSLSASVGDRVTITCKASQNVDTDVAWFQQKPGKAPKGLIYSASSRYSGVPSRFSGSGSGTDFTLTISSLQPEDFATYYCQQYNNYPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 142 - protein, 223 aa, Artificial Sequence; identical to SEQ ID NO: 140
  huAFD.v2.1 Heavy Chain (Table 6)

SEQ ID NO: 143 - protein, 214 aa, Artificial Sequence
  huAFD.v2.1 Light Chain (Table 6)
DIQMTQSPSSLSASVGDRVTITCKASQNVDTDVAWFQQKPGKAPKGLIRSASSRYSGVPSRFSGSGSGTDFTLTISSLQPEDFATYYCQQYNNYPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 144 - protein, 223 aa, Artificial Sequence
  huAFD.v2.3 Heavy Chain (Table 6)
EVQLVQSGAEVKKPGASVKVSCKASGYTFTSYYMYWVRQAPGQGLEWIGEINPYSGDTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHT

SEQ ID NO: 145 - protein, 214 aa, Artificial Sequence; identical to SEQ ID NO: 143
  huAFD.v2.3 Light Chain (Table 6)

SEQ ID NO: 146 - protein, 223 aa, Artificial Sequence
  huAFD.v1 Heavy Chain (Table 6)
EVQLVQSGAEVKKPGASVKVSCKASGYTFTSYYMYWVRQAPGQGLEWIGEINPTNGGTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHT

SEQ ID NO: 147 - protein, 214 aa, Artificial Sequence; identical to SEQ ID NO: 141
  huAFD.v1 Light Chain (Table 6)

SEQ ID NO: 148 - protein, 223 aa, Artificial Sequence
  huAFD.v1.1 Heavy Chain (Table 6)
EVQLVQSGAEVKKPGASVKVSCKASGYTFTSYYMYWVRQAPGQGLEWIGEINPTQGGTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHT

SEQ ID NO: 149 - protein, 214 aa, Artificial Sequence; identical to SEQ ID NO: 141
  huAFD.v1.1 Light Chain (Table 6)

SEQ ID NO: 150 - protein, 223 aa, Artificial Sequence
  huAFD.v2.2 Heavy Chain (Table 6)
EVQLVQSGAEVKKPGASVKVSCKASGYTFTSYYMYWVRQAPGQGLEWIGEINPTSGDTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHT

SEQ ID NO: 151 - protein, 214 aa, Artificial Sequence; identical to SEQ ID NO: 141
  huAFD.v2.2 Light Chain (Table 6)

SEQ ID NO: 152 - protein, 223 aa, Artificial Sequence
  huAFD.v2.4 Heavy Chain (Table 6)
EVQLVQSGAEVKKPGASVKVSCKASGYTFTSYYMYWVRQAPGQGLEWIGEINPTSGETNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHT

SEQ ID NO: 153 - protein, 214 aa, Artificial Sequence; identical to SEQ ID NO: 141
  huAFD.v2.4 Light Chain (Table 6)

SEQ ID NO: 154 - protein, 223 aa, Artificial Sequence
  huAFD.v2.5 Heavy Chain (Table 6)
EVQLVQSGAEVKKPGASVKVSCKASGYTFTSYYMYWVRQAPGQGLEWIGEINPYSGGTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHT

SEQ ID NO: 155 - protein, 214 aa, Artificial Sequence; identical to SEQ ID NO: 141
  huAFD.v2.5 Light Chain (Table 6)

SEQ ID NO: 156 - protein, 223 aa, Artificial Sequence; identical to SEQ ID NO: 140
  huAFD.v2.6 Heavy Chain (Table 6)

SEQ ID NO: 157 - protein, 214 aa, Artificial Sequence
  huAFD.v2.6 Light Chain (Table 6)
DIQMTQSPSSLSASVGDRVTITCKASQNVDTDVAWFQQKPGKAPKGLISSASSRYSGVPSRFSGSGSGTDFTLTISSLQPEDFATYYCQQYNNYPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 158 - protein, 223 aa, Artificial Sequence; identical to SEQ ID NO: 140
  huAFD.v2.7 Heavy Chain (Table 6)

SEQ ID NO: 159 - protein, 214 aa, Artificial Sequence
  huAFD.v2.7 Light Chain (Table 6)
DIQMTQSPSSLSASVGDRVTITCKASQNVDTDVAWFQQKPGKAPKGLIKSASSRYSGVPSRFSGSGSGTDFTLTISSLQPEDFATYYCQQYNNYPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 160 - protein, 223 aa, Artificial Sequence; identical to SEQ ID NO: 140
  huAFD.v2.8 Heavy Chain (Table 6)

SEQ ID NO: 161 - protein, 214 aa, Artificial Sequence
  huAFD.v2.8 Light Chain (Table 6)
DIQMTQSPSSLSASVGDRVTITCKASQNVDTDVAWFQQKPGKAPKGLIQSASSRYSGVPSRFSGSGSGTDFTLTISSLQPEDFATYYCQQYNNYPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 162 - protein, 223 aa, Artificial Sequence
  huAFD.v2.9 Heavy Chain (Table 6)
EVQLVQSGAEVKKPGASVKVSCKASGYTFTSYYMYWVRQAPGQGLEWIGWINPTSGGTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHT

SEQ ID NO: 163 - protein, 214 aa, Artificial Sequence; identical to SEQ ID NO: 141
  huAFD.v2.9 Light Chain (Table 6)

SEQ ID NO: 164 - protein, 223 aa, Artificial Sequence; identical to SEQ ID NO: 140
  huAFD.v2.10 Heavy Chain (Table 6)

SEQ ID NO: 165 - protein, 214 aa, Artificial Sequence
  huAFD.v2.10 Light Chain (Table 6)
DIQMTQSPSSLSASVGDRVTITCKASQNVDTDVAWFQQKPGKAPKGLIYSASSRKSGVPSRFSGSGSGTDFTLTISSLQPEDFATYYCQQYNNYPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 166 - protein, 223 aa, Artificial Sequence; identical to SEQ ID NO: 140
  huAFD.v2.11 Heavy Chain (Table 6)

SEQ ID NO: 167 - protein, 214 aa, Artificial Sequence
  huAFD.v2.11 Light Chain (Table 6)
DIQMTQSPSSLSASVGDRVTITCKASQNVDTDVAWFQQKPGKAPKGLIYSASSRRSGVPSRFSGSGSGTDFTLTISSLQPEDFATYYCQQYNNYPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 168 - protein, 223 aa, Artificial Sequence; identical to SEQ ID NO: 154
  huAFD.v2.12 Heavy Chain (Table 6)

SEQ ID NO: 169 - protein, 214 aa, Artificial Sequence; identical to SEQ ID NO: 143
  huAFD.v2.12 Light Chain (Table 6)

SEQ ID NO: 170 - protein, 223 aa, Artificial Sequence; identical to SEQ ID NO: 140
  huAFD.v2.13 Heavy Chain (Table 6)

SEQ ID NO: 171 - protein, 214 aa, Artificial Sequence
  huAFD.v2.13 Light Chain (Table 6)
DIQMTQSPSSLSASVGDRVTITCKASQNVDTDVAWFQQKPGKAPKGLIRSASSRYSGVPSRFSGSGSGTDFTLTISSLQPEDFATYYCQQYENYPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 172 - protein, 223 aa, Artificial Sequence; identical to SEQ ID NO: 152
  huAFD.v2.14 Heavy Chain (Table 6)

SEQ ID NO: 173 - protein, 214 aa, Artificial Sequence; identical to SEQ ID NO: 143
  huAFD.v2.14 Light Chain (Table 6)

SEQ ID NO: 174 - protein, 223 aa, Artificial Sequence
  huAFD.v2.15 Heavy Chain (Table 6)
EVQLVQSGAEVKKPGASVKVSCKASGYTFTSYYMYWVRQAPGQGLEWIGEINPYSGETNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHT

SEQ ID NO: 175 - protein, 214 aa, Artificial Sequence; identical to SEQ ID NO: 143
  huAFD.v2.15 Light Chain (Table 6)

SEQ ID NO: 176 - protein, 224 aa, Artificial Sequence
  Cys-Modified AFD.v8 Heavy Chain (Table 7)
EVQLVQSGPELKKPGASVKVSCKASGYTFTNYGMNWVRQAPGQGLEWMGWINTYTGETTYAEDFKGRFVFSLDTSVSTAYLQISSLKAEDTAVYYCEREGGVNNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTC

SEQ ID NO: 177 - protein, 227 aa, Artificial Sequence
  Cys-Pro-Pro-Cys-Modified AFD.v8 Heavy Chain (Table 7)
EVQLVQSGPELKKPGASVKVSCKASGYTFTNYGMNWVRQAPGQGLEWMGWINTYTGETTYAEDFKGRFVFSLDTSVSTAYLQISSLKAEDTAVYYCEREGGVNNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPC

SEQ ID NO: 178 - protein, 224 aa, Artificial Sequence
  Cys-Modified AFD.v14 Heavy Chain (Table 7)
EVQLVQSGPELKKPGASVKVSCKASGYTFTNYGMNWVRQAPGQGLEWMGWINTYTGETTYAEDFKGRFVFSLDTSVSTAYLQISSLKAEDTAVYYCEREGGVSNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTC

SEQ ID NO: 179 - protein, 227 aa, Artificial Sequence
  Cys-Pro-Pro-Cys-Modified AFD.v14 Heavy Chain (Table 7)
EVQLVQSGPELKKPGASVKVSCKASGYTFTNYGMNWVRQAPGQGLEWMGWINTYTGETTYAEDFKGRFVFSLDTSVSTAYLQISSLKAEDTAVYYCEREGGVSNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPC

SEQ ID NO: 180 - protein, 219 aa, Artificial Sequence
  C terminal-modified AFD-WT Heavy Chain
EVQLVQSGPELKKPGASVKVSCKASGYTFTNYGMNWVRQAPGQGLEWMGWINTYTGETTYADDFKGRFVFSLDTSVSTAYLQISSLKAEDTAVYYCEREGGVNNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCD

SEQ ID NO: 181 - protein, 219 aa, Artificial Sequence; identical to SEQ ID NO: 180
  C terminal-modified AFD.v1 Heavy Chain

SEQ ID NO: 182 - protein, 219 aa, Artificial Sequence; identical to SEQ ID NO: 180
  C terminal-modified AFD.v2 Heavy Chain

SEQ ID NO: 183 - protein, 219 aa, Artificial Sequence; identical to SEQ ID NO: 180
  C terminal-modified AFD.v3 Heavy Chain

SEQ ID NO: 184 - protein, 219 aa, Artificial Sequence; identical to SEQ ID NO: 180
  C terminal-modified AFD.v4 Heavy Chain

SEQ ID NO: 185 - protein, 219 aa, Artificial Sequence; identical to SEQ ID NO: 180
  C terminal-modified AFD.v5 Heavy Chain

SEQ ID NO: 186 - protein, 219 aa, Artificial Sequence
  C terminal-modified AFD.v6 Heavy Chain
EVQLVQSGPELKKPGASVKVSCKASGYTFTNYGMNWVRQAPGQGLEWMGWINTYTGETTYAEDFKGRFVFSLDTSVSTAYLQISSLKAEDTAVYYCEREGGVNNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCD

SEQ ID NO: 187 - protein, 219 aa, Artificial Sequence; identical to SEQ ID NO: 186
  C terminal-modified AFD.v7 Heavy Chain

SEQ ID NO: 188 - protein, 219 aa, Artificial Sequence; identical to SEQ ID NO: 186
  C terminal-modified AFD.v8 Heavy Chain

SEQ ID NO: 189 - protein, 219 aa, Artificial Sequence; identical to SEQ ID NO: 186
  C terminal-modified AFD.v9 Heavy Chain

SEQ ID NO: 190 - protein, 219 aa, Artificial Sequence; identical to SEQ ID NO: 186
  C terminal-modified AFD.v10 Heavy Chain

SEQ ID NO: 191 - protein, 219 aa, Artificial Sequence
  C terminal-modified AFD.v11 Heavy Chain
EVQLVQSGPELKKPGASVKVSCKASGYTFTNYGMNWVRQAPGQGLEWMGWISTYTGETTYAEDFKGRFVFSLDTSVSTAYLQISSLKAEDTAVYYCEREGGVNNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCD

SEQ ID NO: 192 - protein, 219 aa, Artificial Sequence
  C terminal-modified AFD.v12 Heavy Chain
EVQLVQSGPELKKPGASVKVSCKASGYTFTNYGMNWVRQAPGQGLEWMGWINTYTGETTYAEDFKGRFVFSLDTSVSTAYLQISSLKAEDTAVYYCEREGGVDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCD

SEQ ID NO: 193 - protein, 219 aa, Artificial Sequence
  C terminal-modified AFD.v13 Heavy Chain
EVQLVQSGPELKKPGASVKVSCKASGYTFTNYGMNWVRQAPGQGLEWMGWINTYTGETTYAEDFKGRFVFSLDTSVSTAYLQISSLKAEDTAVYYCEREGGVQNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCD

SEQ ID NO: 194 - protein, 219 aa, Artificial Sequence
  C terminal-modified AFD.v14 Heavy Chain
EVQLVQSGPELKKPGASVKVSCKASGYTFTNYGMNWVRQAPGQGLEWMGWINTYTGETTYAEDFKGRFVFSLDTSVSTAYLQISSLKAEDTAVYYCEREGGVSNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCD

SEQ ID NO: 195 - protein, 219 aa, Artificial Sequence; identical to SEQ ID NO: 194
  C terminal-modified AFD.v15 Heavy Chain

SEQ ID NO: 196 - protein, 219 aa, Artificial Sequence
  C terminal-modified huAFD.v2.0 Heavy Chain
EVQLVQSGAEVKKPGASVKVSCKASGYTFTSYYMYWVRQAPGQGLEWIGEINPTSGGTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCD

SEQ ID NO: 197 - protein, 219 aa, Artificial Sequence; identical to SEQ ID NO: 196
  C terminal-modified huAFD.v2.1 Heavy Chain

SEQ ID NO: 198 - protein, 219 aa, Artificial Sequence
  C terminal-modified huAFD.v2.3 Heavy Chain
EVQLVQSGAEVKKPGASVKVSCKASGYTFTSYYMYWVRQAPGQGLEWIGEINPYSGDTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCD

SEQ ID NO: 199 - protein, 219 aa, Artificial Sequence
  C terminal-modified huAFD.v1 Heavy Chain
EVQLVQSGAEVKKPGASVKVSCKASGYTFTSYYMYWVRQAPGQGLEWIGEINPTNGGTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCD

SEQ ID NO: 200 - protein, 219 aa, Artificial Sequence
  C terminal-modified huAFD.v1.1 Heavy Chain
EVQLVQSGAEVKKPGASVKVSCKASGYTFTSYYMYWVRQAPGQGLEWIGEINPTQGGTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCD

SEQ ID NO: 201 - protein, 219 aa, Artificial Sequence
  C terminal-modified huAFD.v2.2 Heavy Chain
EVQLVQSGAEVKKPGASVKVSCKASGYTFTSYYMYWVRQAPGQGLEWIGEINPTSGDTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCD

SEQ ID NO: 202 - protein, 219 aa, Artificial Sequence
  C terminal-modified huAFD.v2.4 Heavy Chain
EVQLVQSGAEVKKPGASVKVSCKASGYTFTSYYMYWVRQAPGQGLEWIGEINPTSGETNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCD

SEQ ID NO: 203 - protein, 219 aa, Artificial Sequence
  C terminal-modified huAFD.v2.5 Heavy Chain
EVQLVQSGAEVKKPGASVKVSCKASGYTFTSYYMYWVRQAPGQGLEWIGEINPYSGGTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCD

SEQ ID NO: 204 - protein, 219 aa, Artificial Sequence; identical to SEQ ID NO: 196
  C terminal-modified huAFD.v2.6 Heavy Chain

SEQ ID NO: 205 - protein, 219 aa, Artificial Sequence; identical to SEQ ID NO: 196
  C terminal-modified huAFD.v2.7 Heavy Chain

SEQ ID NO: 206 - protein, 219 aa, Artificial Sequence; identical to SEQ ID NO: 196
  C terminal-modified huAFD.v2.8 Heavy Chain

SEQ ID NO: 207 - protein, 219 aa, Artificial Sequence
  C terminal-modified huAFD.v2.9 Heavy Chain
EVQLVQSGAEVKKPGASVKVSCKASGYTFTSYYMYWVRQAPGQGLEWIGWINPTSGGTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCD

SEQ ID NO: 208 - protein, 219 aa, Artificial Sequence; identical to SEQ ID NO: 196
  C terminal-modified huAFD.v2.10 Heavy Chain

SEQ ID NO: 209 - protein, 219 aa, Artificial Sequence; identical to SEQ ID NO: 196
  C terminal-modified huAFD.v2.11 Heavy Chain

SEQ ID NO: 210 - protein, 219 aa, Artificial Sequence; identical to SEQ ID NO: 203
  C terminal-modified huAFD.v2.12 Heavy Chain

SEQ ID NO: 211 - protein, 219 aa, Artificial Sequence; identical to SEQ ID NO: 196
  C terminal-modified huAFD.v2.13 Heavy Chain

SEQ ID NO: 212 - protein, 219 aa, Artificial Sequence; identical to SEQ ID NO: 202
  C terminal-modified huAFD.v2.14 Heavy Chain

SEQ ID NO: 213 - protein, 219 aa, Artificial Sequence
  C terminal-modified huAFD.v2.15 Heavy Chain
EVQLVQSGAEVKKPGASVKVSCKASGYTFTSYYMYWVRQAPGQGLEWIGEINPYSGETNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCD

SEQ ID NO: 214 - protein, 223 aa, Artificial Sequence
  C terminal-modified AFD-WT Heavy Chain
EVQLVQSGPELKKPGASVKVSCKASGYTFTNYGMNWVRQAPGQGLEWMGWINTYTGETTYADDFKGRFVFSLDTSVSTAYLQISSLKAEDTAVYYCEREGGVNNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHL

SEQ ID NO: 215 - protein, 223 aa, Artificial Sequence; identical to SEQ ID NO: 214
  C terminal-modified AFD.v1 Heavy Chain

SEQ ID NO: 216 - protein, 223 aa, Artificial Sequence; identical to SEQ ID NO: 214
  C terminal-modified AFD.v2 Heavy Chain

SEQ ID NO: 217 - protein, 223 aa, Artificial Sequence; identical to SEQ ID NO: 214
  C terminal-modified AFD.v3 Heavy Chain

SEQ ID NO: 218 - protein, 223 aa, Artificial Sequence; identical to SEQ ID NO: 214
  C terminal-modified AFD.v4 Heavy Chain

SEQ ID NO: 219 - protein, 223 aa, Artificial Sequence; identical to SEQ ID NO: 214
  C terminal-modified AFD.v5 Heavy Chain

SEQ ID NO: 220 - protein, 223 aa, Artificial Sequence
  C terminal-modified AFD.v6 Heavy Chain
EVQLVQSGPELKKPGASVKVSCKASGYTFTNYGMNWVRQAPGQGLEWMGWINTYTGETTYAEDFKGRFVFSLDTSVSTAYLQISSLKAEDTAVYYCEREGGVNNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHL

SEQ ID NO: 221 - protein, 223 aa, Artificial Sequence; identical to SEQ ID NO: 220
  C terminal-modified AFD.v7 Heavy Chain

SEQ ID NO: 222 - protein, 223 aa, Artificial Sequence; identical to SEQ ID NO: 220
  C terminal-modified AFD.v8 Heavy Chain

SEQ ID NO: 223 - protein, 223 aa, Artificial Sequence; identical to SEQ ID NO: 220
  C terminal-modified AFD.v9 Heavy Chain

SEQ ID NO: 224 - protein, 223 aa, Artificial Sequence; identical to SEQ ID NO: 220
  C terminal-modified AFD.v10 Heavy Chain

SEQ ID NO: 225 - protein, 223 aa, Artificial Sequence
  C terminal-modified AFD.v11 Heavy Chain
EVQLVQSGPELKKPGASVKVSCKASGYTFTNYGMNWVRQAPGQGLEWMGWISTYTGETTYAEDFKGRFVFSLDTSVSTAYLQISSLKAEDTAVYYCEREGGVNNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHL

SEQ ID NO: 226 - protein, 223 aa, Artificial Sequence
  C terminal-modified AFD.v12 Heavy Chain
EVQLVQSGPELKKPGASVKVSCKASGYTFTNYGMNWVRQAPGQGLEWMGWINTYTGETTYAEDFKGRFVFSLDTSVSTAYLQISSLKAEDTAVYYCEREGGVDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHL

SEQ ID NO: 227 - protein, 223 aa, Artificial Sequence
  C terminal-modified AFD.v13 Heavy Chain
EVQLVQSGPELKKPGASVKVSCKASGYTFTNYGMNWVRQAPGQGLEWMGWINTYTGETTYAEDFKGRFVFSLDTSVSTAYLQISSLKAEDTAVYYCEREGGVQNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHL

SEQ ID NO: 228 - protein, 223 aa, Artificial Sequence
  C terminal-modified AFD.v14 Heavy Chain
EVQLVQSGPELKKPGASVKVSCKASGYTFTNYGMNWVRQAPGQGLEWMGWINTYTGETTYAEDFKGRFVFSLDTSVSTAYLQISSLKAEDTAVYYCEREGGVSNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHL

SEQ ID NO: 229 - protein, 223 aa, Artificial Sequence; identical to SEQ ID NO: 228
  C terminal-modified AFD.v15 Heavy Chain

SEQ ID NO: 230 - protein, 223 aa, Artificial Sequence
  C terminal-modified huAFD.v2.0 Heavy Chain
EVQLVQSGAEVKKPGASVKVSCKASGYTFTSYYMYWVRQAPGQGLEWIGEINPTSGGTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHL

SEQ ID NO: 231 - protein, 223 aa, Artificial Sequence; identical to SEQ ID NO: 230
  C terminal-modified huAFD.v2.1 Heavy Chain

SEQ ID NO: 232 - protein, 223 aa, Artificial Sequence
  C terminal-modified huAFD.v2.3 Heavy Chain
EVQLVQSGAEVKKPGASVKVSCKASGYTFTSYYMYWVRQAPGQGLEWIGEINPYSGDTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHL

SEQ ID NO: 233 - protein, 223 aa, Artificial Sequence
  C terminal-modified huAFD.v1 Heavy Chain
EVQLVQSGAEVKKPGASVKVSCKASGYTFTSYYMYWVRQAPGQGLEWIGEINPTNGGTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHL

SEQ ID NO: 234 - protein, 223 aa, Artificial Sequence
  C terminal-modified huAFD.v1.1 Heavy Chain
EVQLVQSGAEVKKPGASVKVSCKASGYTFTSYYMYWVRQAPGQGLEWIGEINPTQGGTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHL

SEQ ID NO: 235 - protein, 223 aa, Artificial Sequence
  C terminal-modified huAFD.v2.2 Heavy Chain
EVQLVQSGAEVKKPGASVKVSCKASGYTFTSYYMYWVRQAPGQGLEWIGEINPTSGDTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHL

SEQ ID NO: 236 - protein, 223 aa, Artificial Sequence
  C terminal-modified huAFD.v2.4 Heavy Chain
EVQLVQSGAEVKKPGASVKVSCKASGYTFTSYYMYWVRQAPGQGLEWIGEINPTSGETNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHL

SEQ ID NO: 237 - protein, 223 aa, Artificial Sequence
  C terminal-modified huAFD.v2.5 Heavy Chain
EVQLVQSGAEVKKPGASVKVSCKASGYTFTSYYMYWVRQAPGQGLEWIGEINPYSGGTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHL

SEQ ID NO: 238 - protein, 223 aa, Artificial Sequence; identical to SEQ ID NO: 230
  C terminal-modified huAFD.v2.6 Heavy Chain

SEQ ID NO: 239 - protein, 223 aa, Artificial Sequence; identical to SEQ ID NO: 230
  C terminal-modified huAFD.v2.7 Heavy Chain

SEQ ID NO: 240 - protein, 223 aa, Artificial Sequence; identical to SEQ ID NO: 230
  C terminal-modified huAFD.v2.8 Heavy Chain

SEQ ID NO: 241 - protein, 223 aa, Artificial Sequence
  C terminal-modified huAFD.v2.9 Heavy Chain
EVQLVQSGAEVKKPGASVKVSCKASGYTFTSYYMYWVRQAPGQGLEWIGWINPTSGGTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHL

SEQ ID NO: 242 - protein, 223 aa, Artificial Sequence; identical to SEQ ID NO: 230
  C terminal-modified huAFD.v2.10 Heavy Chain

SEQ ID NO: 243 - protein, 223 aa, Artificial Sequence; identical to SEQ ID NO: 230
  C terminal-modified huAFD.v2.11 Heavy Chain

SEQ ID NO: 244 - protein, 223 aa, Artificial Sequence; identical to SEQ ID NO: 237
  C terminal-modified huAFD.v2.12 Heavy Chain

SEQ ID NO: 245 - protein, 223 aa, Artificial Sequence; identical to SEQ ID NO: 230
  C terminal-modified huAFD.v2.13 Heavy Chain

SEQ ID NO: 246 - protein, 223 aa, Artificial Sequence; identical to SEQ ID NO: 236
  C terminal-modified huAFD.v2.14 Heavy Chain

SEQ ID NO: 247 - protein, 223 aa, Artificial Sequence
  C terminal-modified huAFD.v2.15 Heavy Chain
EVQLVQSGAEVKKPGASVKVSCKASGYTFTSYYMYWVRQAPGQGLEWIGEINPYSGETNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHL

SEQ ID NO: 248 - protein, 220 aa, Artificial Sequence
  C terminal-modified AFD-WT Heavy Chain
EVQLVQSGPELKKPGASVKVSCKASGYTFTNYGMNWVRQAPGQGLEWMGWINTYTGETTYADDFKGRFVFSLDTSVSTAYLQISSLKAEDTAVYYCEREGGVNNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDK

SEQ ID NO: 249 - protein, 220 aa, Artificial Sequence; identical to SEQ ID NO: 248
  C terminal-modified AFD.v1 Heavy Chain

SEQ ID NO: 250 - protein, 220 aa, Artificial Sequence; identical to SEQ ID NO: 248
  C terminal-modified AFD.v2 Heavy Chain

SEQ ID NO: 251 - protein, 220 aa, Artificial Sequence; identical to SEQ ID NO: 248
  C terminal-modified AFD.v3 Heavy Chain

SEQ ID NO: 252 - protein, 220 aa, Artificial Sequence; identical to SEQ ID NO: 248
  C terminal-modified AFD.v4 Heavy Chain

SEQ ID NO: 253 - protein, 220 aa, Artificial Sequence; identical to SEQ ID NO: 248
  C terminal-modified AFD.v5 Heavy Chain

SEQ ID NO: 254 - protein, 220 aa, Artificial Sequence
  C terminal-modified AFD.v6 Heavy Chain
EVQLVQSGPELKKPGASVKVSCKASGYTFTNYGMNWVRQAPGQGLEWMGWINTYTGETTYAEDFKGRFVFSLDTSVSTAYLQISSLKAEDTAVYYCEREGGVNNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDK

SEQ ID NO: 255 - protein, 220 aa, Artificial Sequence; identical to SEQ ID NO: 254
  C terminal-modified AFD.v7 Heavy Chain

SEQ ID NO: 256 - protein, 220 aa, Artificial Sequence; identical to SEQ ID NO: 254
  C terminal-modified AFD.v8 Heavy Chain

SEQ ID NO: 257 - protein, 220 aa, Artificial Sequence; identical to SEQ ID NO: 254
  C terminal-modified AFD.v9 Heavy Chain

SEQ ID NO: 258 - protein, 220 aa, Artificial Sequence; identical to SEQ ID NO: 254
  C terminal-modified AFD.v10 Heavy Chain

SEQ ID NO: 259 - protein, 220 aa, Artificial Sequence
  C terminal-modified AFD.v11 Heavy Chain
EVQLVQSGPELKKPGASVKVSCKASGYTFTNYGMNWVRQAPGQGLEWMGWISTYTGETTYAEDFKGRFVFSLDTSVSTAYLQISSLKAEDTAVYYCEREGGVNNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDK

SEQ ID NO: 260 - protein, 220 aa, Artificial Sequence
  C terminal-modified AFD.v12 Heavy Chain
EVQLVQSGPELKKPGASVKVSCKASGYTFTNYGMNWVRQAPGQGLEWMGWINTYTGETTYAEDFKGRFVFSLDTSVSTAYLQISSLKAEDTAVYYCEREGGVDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDK

SEQ ID NO: 261 - protein, 220 aa, Artificial Sequence
  C terminal-modified AFD.v13 Heavy Chain
EVQLVQSGPELKKPGASVKVSCKASGYTFTNYGMNWVRQAPGQGLEWMGWINTYTGETTYAEDFKGRFVFSLDTSVSTAYLQISSLKAEDTAVYYCEREGGVQNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDK

SEQ ID NO: 262 - protein, 220 aa, Artificial Sequence
  C terminal-modified AFD.v14 Heavy Chain
EVQLVQSGPELKKPGASVKVSCKASGYTFTNYGMNWVRQAPGQGLEWMGWINTYTGETTYAEDFKGRFVFSLDTSVSTAYLQISSLKAEDTAVYYCEREGGVSNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDK

SEQ ID NO: 263 - protein, 220 aa, Artificial Sequence; identical to SEQ ID NO: 262
  C terminal-modified AFD.v15 Heavy Chain

SEQ ID NO: 264 - protein, 220 aa, Artificial Sequence
  C terminal-modified huAFD.v2.0 Heavy Chain
EVQLVQSGAEVKKPGASVKVSCKASGYTFTSYYMYWVRQAPGQGLEWIGEINPTSGGTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDK

SEQ ID NO: 265 - protein, 220 aa, Artificial Sequence; identical to SEQ ID NO: 264
  C terminal-modified huAFD.v2.1 Heavy Chain

SEQ ID NO: 266 - protein, 220 aa, Artificial Sequence
  C terminal-modified huAFD.v2.3 Heavy Chain
EVQLVQSGAEVKKPGASVKVSCKASGYTFTSYYMYWVRQAPGQGLEWIGEINPYSGDTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDK

SEQ ID NO: 267 - protein, 220 aa, Artificial Sequence
  C terminal-modified huAFD.v1 Heavy Chain
EVQLVQSGAEVKKPGASVKVSCKASGYTFTSYYMYWVRQAPGQGLEWIGEINPTNGGTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDK

SEQ ID NO: 268 - protein, 220 aa, Artificial Sequence
  C terminal-modified huAFD.v1.1 Heavy Chain
EVQLVQSGAEVKKPGASVKVSCKASGYTFTSYYMYWVRQAPGQGLEWIGEINPTQGGTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDK

SEQ ID NO: 269 - protein, 220 aa, Artificial Sequence
  C terminal-modified huAFD.v2.2 Heavy Chain
EVQLVQSGAEVKKPGASVKVSCKASGYTFTSYYMYWVRQAPGQGLEWIGEINPTSGDTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDK

SEQ ID NO: 270 - protein, 220 aa, Artificial Sequence
  C terminal-modified huAFD.v2.4 Heavy Chain
EVQLVQSGAEVKKPGASVKVSCKASGYTFTSYYMYWVRQAPGQGLEWIGEINPTSGETNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDK

SEQ ID NO: 271 - protein, 220 aa, Artificial Sequence
  C terminal-modified huAFD.v2.5 Heavy Chain
EVQLVQSGAEVKKPGASVKVSCKASGYTFTSYYMYWVRQAPGQGLEWIGEINPYSGGTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDK

SEQ ID NO: 272 - protein, 220 aa, Artificial Sequence; identical to SEQ ID NO: 264
  C terminal-modified huAFD.v2.6 Heavy Chain

SEQ ID NO: 273 - protein, 220 aa, Artificial Sequence; identical to SEQ ID NO: 264
  C terminal-modified huAFD.v2.7 Heavy Chain

SEQ ID NO: 274 - protein, 220 aa, Artificial Sequence; identical to SEQ ID NO: 264
  C terminal-modified huAFD.v2.8 Heavy Chain

SEQ ID NO: 275 - protein, 220 aa, Artificial Sequence
  C terminal-modified huAFD.v2.9 Heavy Chain
EVQLVQSGAEVKKPGASVKVSCKASGYTFTSYYMYWVRQAPGQGLEWIGWINPTSGGTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDK

SEQ ID NO: 276 - protein, 220 aa, Artificial Sequence; identical to SEQ ID NO: 264
  C terminal-modified huAFD.v2.10 Heavy Chain

SEQ ID NO: 277 - protein, 220 aa, Artificial Sequence; identical to SEQ ID NO: 264
  C terminal-modified huAFD.v2.11 Heavy Chain

SEQ ID NO: 278 - protein, 220 aa, Artificial Sequence; identical to SEQ ID NO: 271
  C terminal-modified huAFD.v2.12 Heavy Chain

SEQ ID NO: 279 - protein, 220 aa, Artificial Sequence; identical to SEQ ID NO: 264
  C terminal-modified huAFD.v2.13 Heavy Chain

SEQ ID NO: 280 - protein, 220 aa, Artificial Sequence; identical to SEQ ID NO: 270
  C terminal-modified huAFD.v2.14 Heavy Chain

SEQ ID NO: 281 - protein, 220 aa, Artificial Sequence
  C terminal-modified huAFD.v2.15 Heavy Chain
EVQLVQSGAEVKKPGASVKVSCKASGYTFTSYYMYWVRQAPGQGLEWIGEINPYSGETNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDK

SEQ ID NO: 282 - protein, 221 aa, Artificial Sequence
  C terminal-modified AFD-WT Heavy Chain
EVQLVQSGPELKKPGASVKVSCKASGYTFTNYGMNWVRQAPGQGLEWMGWINTYTGETTYADDFKGRFVFSLDTSVSTAYLQISSLKAEDTAVYYCEREGGVNNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKT

SEQ ID NO: 283 - protein, 221 aa, Artificial Sequence; identical to SEQ ID NO: 282
  C terminal-modified AFD.v1 Heavy Chain

SEQ ID NO: 284 - protein, 221 aa, Artificial Sequence; identical to SEQ ID NO: 282
  C terminal-modified AFD.v2 Heavy Chain

SEQ ID NO: 285 - protein, 221 aa, Artificial Sequence; identical to SEQ ID NO: 282
  C terminal-modified AFD.v3 Heavy Chain

SEQ ID NO: 286 - protein, 221 aa, Artificial Sequence; identical to SEQ ID NO: 282
  C terminal-modified AFD.v4 Heavy Chain

SEQ ID NO: 287 - protein, 221 aa, Artificial Sequence; identical to SEQ ID NO: 282
  C terminal-modified AFD.v5 Heavy Chain

SEQ ID NO: 288 - protein, 221 aa, Artificial Sequence
  C terminal-modified AFD.v6 Heavy Chain
EVQLVQSGPELKKPGASVKVSCKASGYTFTNYGMNWVRQAPGQGLEWMGWINTYTGETTYAEDFKGRFVFSLDTSVSTAYLQISSLKAEDTAVYYCEREGGVNNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKT

SEQ ID NO: 289 - protein, 221 aa, Artificial Sequence; identical to SEQ ID NO: 288
  C terminal-modified AFD.v7 Heavy Chain

SEQ ID NO: 290 - protein, 221 aa, Artificial Sequence; identical to SEQ ID NO: 288
  C terminal-modified AFD.v8 Heavy Chain

SEQ ID NO: 291 - protein, 221 aa, Artificial Sequence; identical to SEQ ID NO: 288
  C terminal-modified AFD.v4 Heavy Chain

SEQ ID NO: 292 - protein, 221 aa, Artificial Sequence; identical to SEQ ID NO: 288
  C terminal-modified AFD.v10 Heavy Chain

SEQ ID NO: 293 - protein, 221 aa, Artificial Sequence
  C terminal-modified AFD.v11 Heavy Chain
EVQLVQSGPELKKPGASVKVSCKASGYTFTNYGMNWVRQAPGQGLEWMGWISTYTGETTYAEDFKGRFVFSLDTSVSTAYLQISSLKAEDTAVYYCEREGGVNNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKT

SEQ ID NO: 294 - protein, 221 aa, Artificial Sequence
  C terminal-modified AFD.v12 Heavy Chain
EVQLVQSGPELKKPGASVKVSCKASGYTFTNYGMNWVRQAPGQGLEWMGWINTYTGETTYAEDFKGRFVFSLDTSVSTAYLQISSLKAEDTAVYYCEREGGVDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKT

SEQ ID NO: 295 - protein, 221 aa, Artificial Sequence
  C terminal-modified AFD.v13 Heavy Chain
EVQLVQSGPELKKPGASVKVSCKASGYTFTNYGMNWVRQAPGQGLEWMGWINTYTGETTYAEDFKGRFVFSLDTSVSTAYLQISSLKAEDTAVYYCEREGGVQNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKT

SEQ ID NO: 296 - protein, 221 aa, Artificial Sequence
  C terminal-modified AFD.v14 Heavy Chain
EVQLVQSGPELKKPGASVKVSCKASGYTFTNYGMNWVRQAPGQGLEWMGWINTYTGETTYAEDFKGRFVFSLDTSVSTAYLQISSLKAEDTAVYYCEREGGVSNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKT

SEQ ID NO: 297 - protein, 221 aa, Artificial Sequence; identical to SEQ ID NO: 296
  C terminal-modified AFD.v15 Heavy Chain

SEQ ID NO: 298 - protein, 221 aa, Artificial Sequence
  C terminal-modified huAFD.v2.0 Heavy Chain
EVQLVQSGAEVKKPGASVKVSCKASGYTFTSYYMYWVRQAPGQGLEWIGEINPTSGGTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKT

SEQ ID NO: 299 - protein, 221 aa, Artificial Sequence; identical to SEQ ID NO: 298
  C terminal-modified huAFD.v2.1 Heavy Chain

SEQ ID NO: 300 - protein, 221 aa, Artificial Sequence
  C terminal-modified huAFD.v2.3 Heavy Chain
EVQLVQSGAEVKKPGASVKVSCKASGYTFTSYYMYWVRQAPGQGLEWIGEINPYSGDTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKT

SEQ ID NO: 301 - protein, 221 aa, Artificial Sequence
  C terminal-modified huAFD.v1 Heavy Chain
EVQLVQSGAEVKKPGASVKVSCKASGYTFTSYYMYWVRQAPGQGLEWIGEINPTNGGTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKT

SEQ ID NO: 302 - protein, 221 aa, Artificial Sequence
  C terminal-modified huAFD.v1.1 Heavy Chain
EVQLVQSGAEVKKPGASVKVSCKASGYTFTSYYMYWVRQAPGQGLEWIGEINPTQGGTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKT

SEQ ID NO: 303 - protein, 221 aa, Artificial Sequence
  C terminal-modified huAFD.v2.2 Heavy Chain
EVQLVQSGAEVKKPGASVKVSCKASGYTFTSYYMYWVRQAPGQGLEWIGEINPTSGDTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKT

SEQ ID NO: 304 - protein, 221 aa, Artificial Sequence
  C terminal-modified huAFD.v2.4 Heavy Chain
EVQLVQSGAEVKKPGASVKVSCKASGYTFTSYYMYWVRQAPGQGLEWIGEINPTSGETNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKT

SEQ ID NO: 305 - protein, 221 aa, Artificial Sequence
  C terminal-modified huAFD.v2.5 Heavy Chain
EVQLVQSGAEVKKPGASVKVSCKASGYTFTSYYMYWVRQAPGQGLEWIGEINPYSGGTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKT

SEQ ID NO: 306 - protein, 221 aa, Artificial Sequence; identical to SEQ ID NO: 298
  C terminal-modified huAFD.v2.6 Heavy Chain

SEQ ID NO: 307 - protein, 221 aa, Artificial Sequence; identical to SEQ ID NO: 298
  C terminal-modified huAFD.v2.7 Heavy Chain

SEQ ID NO: 308 - protein, 221 aa, Artificial Sequence; identical to SEQ ID NO: 298
  C terminal-modified huAFD.v2.8 Heavy Chain

SEQ ID NO: 309 - protein, 221 aa, Artificial Sequence
  C terminal-modified huAFD.v2.9 Heavy Chain
EVQLVQSGAEVKKPGASVKVSCKASGYTFTSYYMYWVRQAPGQGLEWIGWINPTSGGTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKT

SEQ ID NO: 310 - protein, 221 aa, Artificial Sequence; identical to SEQ ID NO: 298
  C terminal-modified huAFD.v2.10 Heavy Chain

SEQ ID NO: 311 - protein, 221 aa, Artificial Sequence; identical to SEQ ID NO: 298
  C terminal-modified huAFD.v2.11 Heavy Chain

SEQ ID NO: 312 - protein, 221 aa, Artificial Sequence; identical to SEQ ID NO: 305
  C terminal-modified huAFD.v2.12 Heavy Chain

SEQ ID NO: 313 - protein, 221 aa, Artificial Sequence; identical to SEQ ID NO: 298
  C terminal-modified huAFD.v2.13 Heavy Chain

SEQ ID NO: 314 - protein, 221 aa, Artificial Sequence; identical to SEQ ID NO: 304
  C terminal-modified huAFD.v2.14 Heavy Chain

SEQ ID NO: 315 - protein, 221 aa, Artificial Sequence
  C terminal-modified huAFD.v2.15 Heavy Chain
EVQLVQSGAEVKKPGASVKVSCKASGYTFTSYYMYWVRQAPGQGLEWIGEINPYSGETNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKT

SEQ ID NO: 316 - protein, 222 aa, Artificial Sequence
  C terminal-modified AFD-WT Heavy Chain
EVQLVQSGPELKKPGASVKVSCKASGYTFTNYGMNWVRQAPGQGLEWMGWINTYTGETTYADDFKGRFVFSLDTSVSTAYLQISSLKAEDTAVYYCEREGGVNNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 317 - protein, 222 aa, Artificial Sequence; identical to SEQ ID NO: 316
  C terminal-modified AFD.v1 Heavy Chain

SEQ ID NO: 318 - protein, 222 aa, Artificial Sequence; identical to SEQ ID NO: 316
  C terminal-modified AFD.v2 Heavy Chain

SEQ ID NO: 319 - protein, 222 aa, Artificial Sequence; identical to SEQ ID NO: 316
  C terminal-modified AFD.v3 Heavy Chain

SEQ ID NO: 320 - protein, 222 aa, Artificial Sequence; identical to SEQ ID NO: 316
  C terminal-modified AFD.v4 Heavy Chain

SEQ ID NO: 321 - protein, 222 aa, Artificial Sequence; identical to SEQ ID NO: 316
  C terminal-modified AFD.v5 Heavy Chain

SEQ ID NO: 322 - protein, 222 aa, Artificial Sequence
  C terminal-modified AFD.v6 Heavy Chain
EVQLVQSGPELKKPGASVKVSCKASGYTFTNYGMNWVRQAPGQGLEWMGWINTYTGETTYAEDFKGRFVFSLDTSVSTAYLQISSLKAEDTAVYYCEREGGVNNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 323 - protein, 222 aa, Artificial Sequence; identical to SEQ ID NO: 322
  C terminal-modified AFD.v7 Heavy Chain

SEQ ID NO: 324 - protein, 222 aa, Artificial Sequence; identical to SEQ ID NO: 322
  C terminal-modified AFD.v8 Heavy Chain

SEQ ID NO: 325 - protein, 222 aa, Artificial Sequence; identical to SEQ ID NO: 322
  C terminal-modified AFD.v9 Heavy Chain

SEQ ID NO: 326 - protein, 222 aa, Artificial Sequence; identical to SEQ ID NO: 322
  C terminal-modified AFD.v10 Heavy Chain

SEQ ID NO: 327 - protein, 222 aa, Artificial Sequence
  C terminal-modified AFD.v11 Heavy Chain
EVQLVQSGPELKKPGASVKVSCKASGYTFTNYGMNWVRQAPGQGLEWMGWISTYTGETTYAEDFKGRFVFSLDTSVSTAYLQISSLKAEDTAVYYCEREGGVNNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 328 - protein, 222 aa, Artificial Sequence
  C terminal-modified AFD.v12 Heavy Chain
EVQLVQSGPELKKPGASVKVSCKASGYTFTNYGMNWVRQAPGQGLEWMGWINTYTGETTYAEDFKGRFVFSLDTSVSTAYLQISSLKAEDTAVYYCEREGGVDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 329 - protein, 222 aa, Artificial Sequence
  C terminal-modified AFD.v13 Heavy Chain
EVQLVQSGPELKKPGASVKVSCKASGYTFTNYGMNWVRQAPGQGLEWMGWINTYTGETTYAEDFKGRFVFSLDTSVSTAYLQISSLKAEDTAVYYCEREGGVQNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 330 - protein, 222 aa, Artificial Sequence
  C terminal-modified AFD.v14 Heavy Chain
EVQLVQSGPELKKPGASVKVSCKASGYTFTNYGMNWVRQAPGQGLEWMGWINTYTGETTYAEDFKGRFVFSLDTSVSTAYLQISSLKAEDTAVYYCEREGGVSNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 331 - protein, 222 aa, Artificial Sequence; identical to SEQ ID NO: 330
  C terminal-modified AFD.v15 Heavy Chain

SEQ ID NO: 332 - protein, 222 aa, Artificial Sequence
  C terminal-modified huAFD.v2.0 Heavy Chain
EVQLVQSGAEVKKPGASVKVSCKASGYTFTSYYMYWVRQAPGQGLEWIGEINPTSGGTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 333 - protein, 222 aa, Artificial Sequence; identical to SEQ ID NO: 332
  C terminal-modified huAFD.v2.1 Heavy Chain

SEQ ID NO: 334 - protein, 222 aa, Artificial Sequence
  C terminal-modified huAFD.v2.3 Heavy Chain
EVQLVQSGAEVKKPGASVKVSCKASGYTFTSYYMYWVRQAPGQGLEWIGEINPYSGDTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 335 - protein, 222 aa, Artificial Sequence
  C terminal-modified huAFD.v1 Heavy Chain
EVQLVQSGAEVKKPGASVKVSCKASGYTFTSYYMYWVRQAPGQGLEWIGEINPTNGGTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 336 - protein, 222 aa, Artificial Sequence
  C terminal-modified huAFD.v1.1 Heavy Chain
EVQLVQSGAEVKKPGASVKVSCKASGYTFTSYYMYWVRQAPGQGLEWIGEINPTQGGTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 337 - protein, 222 aa, Artificial Sequence
  C terminal-modified huAFD.v2.2 Heavy Chain
EVQLVQSGAEVKKPGASVKVSCKASGYTFTSYYMYWVRQAPGQGLEWIGEINPTSGDTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 338 - protein, 222 aa, Artificial Sequence
  C terminal-modified huAFD.v2.4 Heavy Chain
EVQLVQSGAEVKKPGASVKVSCKASGYTFTSYYMYWVRQAPGQGLEWIGEINPTSGETNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 339 - protein, 222 aa, Artificial Sequence
  C terminal-modified huAFD.v2.5 Heavy Chain
EVQLVQSGAEVKKPGASVKVSCKASGYTFTSYYMYWVRQAPGQGLEWIGEINPYSGGTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 340 - protein, 222 aa, Artificial Sequence; identical to SEQ ID NO: 332
  C terminal-modified huAFD.v2.6 Heavy Chain

SEQ ID NO: 341 - protein, 222 aa, Artificial Sequence; identical to SEQ ID NO: 332
  C terminal-modified huAFD.v2.7 Heavy Chain

SEQ ID NO: 342 - protein, 222 aa, Artificial Sequence; identical to SEQ ID NO: 332
  C terminal-modified huAFD.v2.8 Heavy Chain

SEQ ID NO: 343 - protein, 222 aa, Artificial Sequence
  C terminal-modified huAFD.v2.9 Heavy Chain
EVQLVQSGAEVKKPGASVKVSCKASGYTFTSYYMYWVRQAPGQGLEWIGWINPTSGGTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 344 - protein, 222 aa, Artificial Sequence; identical to SEQ ID NO: 332
  C terminal-modified huAFD.v2.10 Heavy Chain

SEQ ID NO: 345 - protein, 222 aa, Artificial Sequence; identical to SEQ ID NO: 332
  C terminal-modified huAFD.v2.11 Heavy Chain

SEQ ID NO: 346 - protein, 222 aa, Artificial Sequence; identical to SEQ ID NO: 339
  tC terminal-modified huAFD.v2.12 Heavy Chain

SEQ ID NO: 347 - protein, 222 aa, Artificial Sequence; identical to SEQ ID NO: 332
  C terminal-modified huAFD.v2.13 Heavy Chain

SEQ ID NO: 348 - protein, 222 aa, Artificial Sequence; identical to SEQ ID NO: 338
  C terminal-modified huAFD.v2.14 Heavy Chain

SEQ ID NO: 349 - protein, 222 aa, Artificial Sequence
  C terminal-modified huAFD.v2.15 Heavy Chain
EVQLVQSGAEVKKPGASVKVSCKASGYTFTSYYMYWVRQAPGQGLEWIGEINPYSGETNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 350 - protein, 224 aa, Artificial Sequence
  C terminal-modified AFD-WT Heavy Chain
EVQLVQSGPELKKPGASVKVSCKASGYTFTNYGMNWVRQAPGQGLEWMGWINTYTGETTYADDFKGRFVFSLDTSVSTAYLQISSLKAEDTAVYYCEREGGVNNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTC

SEQ ID NO: 351 - protein, 224 aa, Artificial Sequence; identical to SEQ ID NO: 350
  C terminal-modified AFD.v1 Heavy Chain

SEQ ID NO: 352 - protein, 224 aa, Artificial Sequence; identical to SEQ ID NO: 350
  C terminal-modified AFD.v2 Heavy Chain

SEQ ID NO: 353 - protein, 224 aa, Artificial Sequence; identical to SEQ ID NO: 350
  C terminal-modified AFD.v3 Heavy Chain

SEQ ID NO: 354 - protein, 224 aa, Artificial Sequence; identical to SEQ ID NO: 350
  C terminal-modified AFD.v4 Heavy Chain

SEQ ID NO: 355 - protein, 224 aa, Artificial Sequence; identical to SEQ ID NO: 350
  C terminal-modified AFD.v5 Heavy Chain

SEQ ID NO: 356 - protein, 224 aa, Artificial Sequence; identical to SEQ ID NO: 176
  C terminal-modified AFD.v6 Heavy Chain

SEQ ID NO: 357 - protein, 224 aa, Artificial Sequence; identical to SEQ ID NO: 176
  C terminal-modified AFD.v7 Heavy Chain

SEQ ID NO: 358 - protein, 224 aa, Artificial Sequence; identical to SEQ ID NO: 176
  C terminal-modified AFD.v8 Heavy Chain

SEQ ID NO: 359 - protein, 224 aa, Artificial Sequence; identical to SEQ ID NO: 176
  C terminal-modified AFD.v9 Heavy Chain

SEQ ID NO: 360 - protein, 224 aa, Artificial Sequence; identical to SEQ ID NO: 176
  C terminal-modified AFD.v10 Heavy Chain

SEQ ID NO: 361 - protein, 224 aa, Artificial Sequence
  C terminal-modified AFD.v11 Heavy Chain
EVQLVQSGPELKKPGASVKVSCKASGYTFTNYGMNWVRQAPGQGLEWMGWISTYTGETTYAEDFKGRFVFSLDTSVSTAYLQISSLKAEDTAVYYCEREGGVNNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTC

SEQ ID NO: 362 - protein, 224 aa, Artificial Sequence
  C terminal-modified AFD.v12 Heavy Chain
EVQLVQSGPELKKPGASVKVSCKASGYTFTNYGMNWVRQAPGQGLEWMGWINTYTGETTYAEDFKGRFVFSLDTSVSTAYLQISSLKAEDTAVYYCEREGGVDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTC

SEQ ID NO: 363 - protein, 224 aa, Artificial Sequence
  C terminal-modified AFD.v13 Heavy Chain
EVQLVQSGPELKKPGASVKVSCKASGYTFTNYGMNWVRQAPGQGLEWMGWINTYTGETTYAEDFKGRFVFSLDTSVSTAYLQISSLKAEDTAVYYCEREGGVQNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTC

SEQ ID NO: 364 - protein, 224 aa, Artificial Sequence; identical to SEQ ID NO: 178
  C terminal-modified AFD.v14 Heavy Chain

SEQ ID NO: 365 - protein, 224 aa, Artificial Sequence; identical to SEQ ID NO: 178
  C terminal-modified AFD.v15 Heavy Chain

SEQ ID NO: 366 - protein, 224 aa, Artificial Sequence
  C terminal-modified huAFD.v2.0 Heavy Chain
EVQLVQSGAEVKKPGASVKVSCKASGYTFTSYYMYWVRQAPGQGLEWIGEINPTSGGTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTC

SEQ ID NO: 367 - protein, 224 aa, Artificial Sequence; identical to SEQ ID NO: 366
  C terminal-modified huAFD.v2.1 Heavy Chain

SEQ ID NO: 368 - protein, 224 aa, Artificial Sequence
  C terminal-modified huAFD.v2.3 Heavy Chain
EVQLVQSGAEVKKPGASVKVSCKASGYTFTSYYMYWVRQAPGQGLEWIGEINPYSGDTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTC

SEQ ID NO: 369 - protein, 224 aa, Artificial Sequence
  C terminal-modified huAFD.v1 Heavy Chain
EVQLVQSGAEVKKPGASVKVSCKASGYTFTSYYMYWVRQAPGQGLEWIGEINPTNGGTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTC

SEQ ID NO: 370 - protein, 224 aa, Artificial Sequence
  C terminal-modified huAFD.v1.1 Heavy Chain
EVQLVQSGAEVKKPGASVKVSCKASGYTFTSYYMYWVRQAPGQGLEWIGEINPTQGGTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTC

SEQ ID NO: 371 - protein, 224 aa, Artificial Sequence
  C terminal-modified huAFD.v2.2 Heavy Chain
EVQLVQSGAEVKKPGASVKVSCKASGYTFTSYYMYWVRQAPGQGLEWIGEINPTSGDTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTC

SEQ ID NO: 372 - protein, 224 aa, Artificial Sequence
  C terminal-modified huAFD.v2.4 Heavy Chain
EVQLVQSGAEVKKPGASVKVSCKASGYTFTSYYMYWVRQAPGQGLEWIGEINPTSGETNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTC

SEQ ID NO: 373 - protein, 224 aa, Artificial Sequence
  C terminal-modified huAFD.v2.5 Heavy Chain
EVQLVQSGAEVKKPGASVKVSCKASGYTFTSYYMYWVRQAPGQGLEWIGEINPYSGGTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTC

SEQ ID NO: 374 - protein, 224 aa, Artificial Sequence; identical to SEQ ID NO: 366
  C terminal-modified huAFD.v2.6 Heavy Chain

SEQ ID NO: 375 - protein, 224 aa, Artificial Sequence; identical to SEQ ID NO: 366
  C terminal-modified huAFD.v2.7 Heavy Chain

SEQ ID NO: 376 - protein, 224 aa, Artificial Sequence; identical to SEQ ID NO: 366
  C terminal-modified huAFD.v2.8 Heavy Chain

SEQ ID NO: 377 - protein, 224 aa, Artificial Sequence
  C terminal-modified huAFD.v2.9 Heavy Chain
EVQLVQSGAEVKKPGASVKVSCKASGYTFTSYYMYWVRQAPGQGLEWIGWINPTSGGTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTC

SEQ ID NO: 378 - protein, 224 aa, Artificial Sequence; identical to SEQ ID NO: 366
  C terminal-modified huAFD.v2.10 Heavy Chain

SEQ ID NO: 379 - protein, 224 aa, Artificial Sequence; identical to SEQ ID NO: 366
  C terminal-modified huAFD.v2.11 Heavy Chain

SEQ ID NO: 380 - protein, 224 aa, Artificial Sequence; identical to SEQ ID NO: 373
  C terminal-modified huAFD.v2.12 Heavy Chain

SEQ ID NO: 381 - protein, 224 aa, Artificial Sequence; identical to SEQ ID NO: 366
  C terminal-modified huAFD.v2.13 Heavy Chain

SEQ ID NO: 382 - protein, 224 aa, Artificial Sequence; identical to SEQ ID NO: 372
  C terminal-modified huAFD.v2.14 Heavy Chain

SEQ ID NO: 383 - protein, 224 aa, Artificial Sequence
  C terminal-modified huAFD.v2.15 Heavy Chain
EVQLVQSGAEVKKPGASVKVSCKASGYTFTSYYMYWVRQAPGQGLEWIGEINPYSGETNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTC

SEQ ID NO: 384 - protein, 227 aa, Artificial Sequence
  C terminal-modified AFD-WT Heavy Chain
EVQLVQSGPELKKPGASVKVSCKASGYTFTNYGMNWVRQAPGQGLEWMGWINTYTGETTYADDFKGRFVFSLDTSVSTAYLQISSLKAEDTAVYYCEREGGVNNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPC

SEQ ID NO: 385 - protein, 227 aa, Artificial Sequence; identical to SEQ ID NO: 384
  C terminal-modified AFD.v1 Heavy Chain

SEQ ID NO: 386 - protein, 227 aa, Artificial Sequence; identical to SEQ ID NO: 384
  C terminal-modified AFD.v2 Heavy Chain

SEQ ID NO: 387 - protein, 227 aa, Artificial Sequence; identical to SEQ ID NO: 384
  C terminal-modified AFD.v3 Heavy Chain

SEQ ID NO: 388 - protein, 227 aa, Artificial Sequence; identical to SEQ ID NO: 384
  C terminal-modified AFD.v4 Heavy Chain

SEQ ID NO: 389 - protein, 227 aa, Artificial Sequence; identical to SEQ ID NO: 384
  C terminal-modified AFD.v5 Heavy Chain

SEQ ID NO: 390 - protein, 227 aa, Artificial Sequence; identical to SEQ ID NO: 177
  C terminal-modified AFD.v6 Heavy Chain

SEQ ID NO: 391 - protein, 227 aa, Artificial Sequence; identical to SEQ ID NO: 177
  C terminal-modified AFD.v7 Heavy Chain

SEQ ID NO: 392 - protein, 227 aa, Artificial Sequence; identical to SEQ ID NO: 177
  C terminal-modified AFD.v8 Heavy Chain

SEQ ID NO: 393 - protein, 227 aa, Artificial Sequence; identical to SEQ ID NO: 177
  C terminal-modified AFD.v9 Heavy Chain

SEQ ID NO: 394 - protein, 227 aa, Artificial Sequence; identical to SEQ ID NO: 177
  C terminal-modified AFD.v10 Heavy Chain

SEQ ID NO: 395 - protein, 227 aa, Artificial Sequence
  C terminal-modified AFD.v11 Heavy Chain
EVQLVQSGPELKKPGASVKVSCKASGYTFTNYGMNWVRQAPGQGLEWMGWISTYTGETTYAEDFKGRFVFSLDTSVSTAYLQISSLKAEDTAVYYCEREGGVNNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPC

SEQ ID NO: 396 - protein, 227 aa, Artificial Sequence
  C terminal-modified AFD.v12 Heavy Chain
EVQLVQSGPELKKPGASVKVSCKASGYTFTNYGMNWVRQAPGQGLEWMGWINTYTGETTYAEDFKGRFVFSLDTSVSTAYLQISSLKAEDTAVYYCEREGGVDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPC

SEQ ID NO: 397 - protein, 227 aa, Artificial Sequence
  C terminal-modified AFD.v13 Heavy Chain
EVQLVQSGPELKKPGASVKVSCKASGYTFTNYGMNWVRQAPGQGLEWMGWINTYTGETTYAEDFKGRFVFSLDTSVSTAYLQISSLKAEDTAVYYCEREGGVQNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPC

SEQ ID NO: 398 - protein, 227 aa, Artificial Sequence; identical to SEQ ID NO: 179
  C terminal-modified AFD.v14 Heavy Chain

SEQ ID NO: 399 - protein, 227 aa, Artificial Sequence; identical to SEQ ID NO: 179
  C terminal-modified AFD.v15 Heavy Chain

SEQ ID NO: 400 - protein, 227 aa, Artificial Sequence
  C terminal-modified huAFD.v2.0 Heavy Chain
EVQLVQSGAEVKKPGASVKVSCKASGYTFTSYYMYWVRQAPGQGLEWIGEINPTSGGTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPC

SEQ ID NO: 401 - protein, 227 aa, Artificial Sequence; identical to SEQ ID NO: 400
  C terminal-modified huAFD.v2.1 Heavy Chain

SEQ ID NO: 402 - protein, 227 aa, Artificial Sequence
  C terminal-modified huAFD.v2.3 Heavy Chain
EVQLVQSGAEVKKPGASVKVSCKASGYTFTSYYMYWVRQAPGQGLEWIGEINPYSGDTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPC

SEQ ID NO: 403 - protein, 227 aa, Artificial Sequence
  C terminal-modified huAFD.v1 Heavy Chain
EVQLVQSGAEVKKPGASVKVSCKASGYTFTSYYMYWVRQAPGQGLEWIGEINPTNGGTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPC

SEQ ID NO: 404 - protein, 227 aa, Artificial Sequence
  C terminal-modified huAFD.v1.1 Heavy Chain
EVQLVQSGAEVKKPGASVKVSCKASGYTFTSYYMYWVRQAPGQGLEWIGEINPTQGGTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPC

SEQ ID NO: 405 - protein, 227 aa, Artificial Sequence
  C terminal-modified huAFD.v2.2 Heavy Chain
EVQLVQSGAEVKKPGASVKVSCKASGYTFTSYYMYWVRQAPGQGLEWIGEINPTSGDTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPC

SEQ ID NO: 406 - protein, 227 aa, Artificial Sequence
  C terminal-modified huAFD.v2.4 Heavy Chain
EVQLVQSGAEVKKPGASVKVSCKASGYTFTSYYMYWVRQAPGQGLEWIGEINPTSGETNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPC

SEQ ID NO: 407 - protein, 227 aa, Artificial Sequence
  C terminal-modified huAFD.v2.5 Heavy Chain
EVQLVQSGAEVKKPGASVKVSCKASGYTFTSYYMYWVRQAPGQGLEWIGEINPYSGGTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPC

SEQ ID NO: 408 - protein, 227 aa, Artificial Sequence; identical to SEQ ID NO: 400
  C terminal-modified huAFD.v2.6 Heavy Chain

SEQ ID NO: 409 - protein, 227 aa, Artificial Sequence; identical to SEQ ID NO: 400
  C terminal-modified huAFD.v2.7 Heavy Chain

SEQ ID NO: 410 - protein, 227 aa, Artificial Sequence; identical to SEQ ID NO: 400
  C terminal-modified huAFD.v2.8 Heavy Chain

SEQ ID NO: 411 - protein, 227 aa, Artificial Sequence
  C terminal-modified huAFD.v2.9 Heavy Chain
EVQLVQSGAEVKKPGASVKVSCKASGYTFTSYYMYWVRQAPGQGLEWIGWINPTSGGTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPC

SEQ ID NO: 412 - protein, 227 aa, Artificial Sequence; identical to SEQ ID NO: 400
  C terminal-modified huAFD.v2.10 Heavy Chain

SEQ ID NO: 413 - protein, 227 aa, Artificial Sequence; identical to SEQ ID NO: 400
  C terminal-modified huAFD.v2.11 Heavy Chain

SEQ ID NO: 414 - protein, 227 aa, Artificial Sequence; identical to SEQ ID NO: 407
  C terminal-modified huAFD.v2.12 Heavy Chain

SEQ ID NO: 415 - protein, 227 aa, Artificial Sequence; identical to SEQ ID NO: 400
  C terminal-modified huAFD.v2.13 Heavy Chain

SEQ ID NO: 416 - protein, 227 aa, Artificial Sequence; identical to SEQ ID NO: 406
  C terminal-modified huAFD.v2.14 Heavy Chain

SEQ ID NO: 417 - protein, 227 aa, Artificial Sequence
  C terminal-modified huAFD.v2.15 Heavy Chain
EVQLVQSGAEVKKPGASVKVSCKASGYTFTSYYMYWVRQAPGQGLEWIGEINPYSGETNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPC

SEQ ID NO: 418 - protein, 227 aa, Artificial Sequence
  C terminal-modified AFD-WT Heavy Chain
EVQLVQSGPELKKPGASVKVSCKASGYTFTNYGMNWVRQAPGQGLEWMGWINTYTGETTYADDFKGRFVFSLDTSVSTAYLQISSLKAEDTAVYYCEREGGVNNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPS

SEQ ID NO: 419 - protein, 227 aa, Artificial Sequence; identical to SEQ ID NO: 418
  C terminal-modified AFD.v1 Heavy Chain

SEQ ID NO: 420 - protein, 227 aa, Artificial Sequence; identical to SEQ ID NO: 418
  C terminal-modified AFD.v2 Heavy Chain

SEQ ID NO: 421 - protein, 227 aa, Artificial Sequence; identical to SEQ ID NO: 418
  C terminal-modified AFD.v3 Heavy Chain

SEQ ID NO: 422 - protein, 227 aa, Artificial Sequence; identical to SEQ ID NO: 418
  C terminal-modified AFD.v4 Heavy Chain

SEQ ID NO: 423 - protein, 227 aa, Artificial Sequence; identical to SEQ ID NO: 418
  C terminal-modified AFD.v5 Heavy Chain

SEQ ID NO: 424 - protein, 227 aa, Artificial Sequence
  C terminal-modified AFD.v6 Heavy Chain
EVQLVQSGPELKKPGASVKVSCKASGYTFTNYGMNWVRQAPGQGLEWMGWINTYTGETTYAEDFKGRFVFSLDTSVSTAYLQISSLKAEDTAVYYCEREGGVNNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPS

SEQ ID NO: 425 - protein, 227 aa, Artificial Sequence; identical to SEQ ID NO: 424
  C terminal-modified AFD.v7 Heavy Chain

SEQ ID NO: 426 - protein, 227 aa, Artificial Sequence; identical to SEQ ID NO: 424
  C terminal-modified AFD.v8 Heavy Chain

SEQ ID NO: 427 - protein, 227 aa, Artificial Sequence; identical to SEQ ID NO: 424
  C terminal-modified AFD.v9 Heavy Chain

SEQ ID NO: 428 - protein, 227 aa, Artificial Sequence; identical to SEQ ID NO: 424
  C terminal-modified AFD.v10 Heavy Chain

SEQ ID NO: 429 - protein, 227 aa, Artificial Sequence
  C terminal-modified AFD.v11 Heavy Chain
EVQLVQSGPELKKPGASVKVSCKASGYTFTNYGMNWVRQAPGQGLEWMGWISTYTGETTYAEDFKGRFVFSLDTSVSTAYLQISSLKAEDTAVYYCEREGGVNNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPS

SEQ ID NO: 430 - protein, 227 aa, Artificial Sequence
  C terminal-modified AFD.v12 Heavy Chain
EVQLVQSGPELKKPGASVKVSCKASGYTFTNYGMNWVRQAPGQGLEWMGWINTYTGETTYAEDFKGRFVFSLDTSVSTAYLQISSLKAEDTAVYYCEREGGVDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPS

SEQ ID NO: 431 - protein, 227 aa, Artificial Sequence
  C terminal-modified AFD.v13 Heavy Chain
EVQLVQSGPELKKPGASVKVSCKASGYTFTNYGMNWVRQAPGQGLEWMGWINTYTGETTYAEDFKGRFVFSLDTSVSTAYLQISSLKAEDTAVYYCEREGGVQNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPS

SEQ ID NO: 432 - protein, 227 aa, Artificial Sequence
  C terminal-modified AFD.v14 Heavy Chain
EVQLVQSGPELKKPGASVKVSCKASGYTFTNYGMNWVRQAPGQGLEWMGWINTYTGETTYAEDFKGRFVFSLDTSVSTAYLQISSLKAEDTAVYYCEREGGVSNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPS

SEQ ID NO: 433 - protein, 227 aa, Artificial Sequence; identical to SEQ ID NO: 432
  C terminal-modified AFD.v15 Heavy Chain

SEQ ID NO: 434 - protein, 227 aa, Artificial Sequence
  C terminal-modified huAFD.v2.0 Heavy Chain
EVQLVQSGAEVKKPGASVKVSCKASGYTFTSYYMYWVRQAPGQGLEWIGEINPTSGGTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPS

SEQ ID NO: 435 - protein, 227 aa, Artificial Sequence; identical to SEQ ID NO: 434
  C terminal-modified huAFD.v2.1 Heavy Chain

SEQ ID NO: 436 - protein, 227 aa, Artificial Sequence
  C terminal-modified huAFD.v2.3 Heavy Chain
EVQLVQSGAEVKKPGASVKVSCKASGYTFTSYYMYWVRQAPGQGLEWIGEINPYSGDTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPS

SEQ ID NO: 437 - protein, 227 aa, Artificial Sequence
  C terminal-modified huAFD.v1 Heavy Chain
EVQLVQSGAEVKKPGASVKVSCKASGYTFTSYYMYWVRQAPGQGLEWIGEINPTNGGTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPS

SEQ ID NO: 438 - protein, 227 aa, Artificial Sequence
  C terminal-modified huAFD.v1.1 Heavy Chain
EVQLVQSGAEVKKPGASVKVSCKASGYTFTSYYMYWVRQAPGQGLEWIGEINPTQGGTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPS

SEQ ID NO: 439 - protein, 227 aa, Artificial Sequence
  C terminal-modified huAFD.v2.2 Heavy Chain
EVQLVQSGAEVKKPGASVKVSCKASGYTFTSYYMYWVRQAPGQGLEWIGEINPTSGDTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPS

SEQ ID NO: 440 - protein, 227 aa, Artificial Sequence
  C terminal-modified huAFD.v2.4 Heavy Chain
EVQLVQSGAEVKKPGASVKVSCKASGYTFTSYYMYWVRQAPGQGLEWIGEINPTSGETNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPS

SEQ ID NO: 441 - protein, 227 aa, Artificial Sequence
  C terminal-modified huAFD.v2.5 Heavy Chain
EVQLVQSGAEVKKPGASVKVSCKASGYTFTSYYMYWVRQAPGQGLEWIGEINPYSGGTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPS

SEQ ID NO: 442 - protein, 227 aa, Artificial Sequence; identical to SEQ ID NO: 434
  C terminal-modified huAFD.v2.6 Heavy Chain

SEQ ID NO: 443 - protein, 227 aa, Artificial Sequence; identical to SEQ ID NO: 434
  C terminal-modified huAFD.v2.7 Heavy Chain

SEQ ID NO: 444 - protein, 227 aa, Artificial Sequence; identical to SEQ ID NO: 434
  C terminal-modified huAFD.v2.8 Heavy Chain

SEQ ID NO: 445 - protein, 227 aa, Artificial Sequence
  C terminal-modified huAFD.v2.9 Heavy Chain
EVQLVQSGAEVKKPGASVKVSCKASGYTFTSYYMYWVRQAPGQGLEWIGWINPTSGGTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPS

SEQ ID NO: 446 - protein, 227 aa, Artificial Sequence; identical to SEQ ID NO: 434
  C terminal-modified huAFD.v2.10 Heavy Chain

SEQ ID NO: 447 - protein, 227 aa, Artificial Sequence; identical to SEQ ID NO: 434
  C terminal-modified huAFD.v2.11 Heavy Chain

SEQ ID NO: 448 - protein, 227 aa, Artificial Sequence; identical to SEQ ID NO: 441
  C terminal-modified huAFD.v2.12 Heavy Chain

SEQ ID NO: 449 - protein, 227 aa, Artificial Sequence; identical to SEQ ID NO: 434
  C terminal-modified huAFD.v2.13 Heavy Chain

SEQ ID NO: 450 - protein, 227 aa, Artificial Sequence; identical to SEQ ID NO: 440
  C terminal-modified huAFD.v2.14 Heavy Chain

SEQ ID NO: 451 - protein, 227 aa, Artificial Sequence
  C terminal-modified huAFD.v2.15 Heavy Chain
EVQLVQSGAEVKKPGASVKVSCKASGYTFTSYYMYWVRQAPGQGLEWIGEINPYSGETNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPS

SEQ ID NO: 452 - protein, 227 aa, Artificial Sequence
  C terminal-modified AFD-WT Heavy Chain
EVQLVQSGPELKKPGASVKVSCKASGYTFTNYGMNWVRQAPGQGLEWMGWINTYTGETTYADDFKGRFVFSLDTSVSTAYLQISSLKAEDTAVYYCEREGGVNNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTSPPC

SEQ ID NO: 453 - protein, 227 aa, Artificial Sequence; identical to SEQ ID NO: 452
  C terminal-modified AFD.v1 Heavy Chain

SEQ ID NO: 454 - protein, 227 aa, Artificial Sequence; identical to SEQ ID NO: 452
  C terminal-modified AFD.v2 Heavy Chain

SEQ ID NO: 455 - protein, 227 aa, Artificial Sequence; identical to SEQ ID NO: 452
  C terminal-modified AFD.v3 Heavy Chain

SEQ ID NO: 456 - protein, 227 aa, Artificial Sequence; identical to SEQ ID NO: 452
  C terminal-modified AFD.v4 Heavy Chain

SEQ ID NO: 457 - protein, 227 aa, Artificial Sequence; identical to SEQ ID NO: 452
  C terminal-modified AFD.v5 Heavy Chain

SEQ ID NO: 458 - protein, 227 aa, Artificial Sequence
  C terminal-modified AFD.v6 Heavy Chain
EVQLVQSGPELKKPGASVKVSCKASGYTFTNYGMNWVRQAPGQGLEWMGWINTYTGETTYAEDFKGRFVFSLDTSVSTAYLQISSLKAEDTAVYYCEREGGVNNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTSPPC

SEQ ID NO: 459 - protein, 227 aa, Artificial Sequence; identical to SEQ ID NO: 458
  C terminal-modified AFD.v7 Heavy Chain

SEQ ID NO: 460 - protein, 227 aa, Artificial Sequence; identical to SEQ ID NO: 458
  C terminal-modified AFD.v8 Heavy Chain

SEQ ID NO: 461 - protein, 227 aa, Artificial Sequence; identical to SEQ ID NO: 458
  C terminal-modified AFD.v9 Heavy Chain

SEQ ID NO: 462 - protein, 227 aa, Artificial Sequence; identical to SEQ ID NO: 458
  C terminal-modified AFD.v10 Heavy Chain

SEQ ID NO: 463 - protein, 227 aa, Artificial Sequence
  C terminal-modified AFD.v11 Heavy Chain
EVQLVQSGPELKKPGASVKVSCKASGYTFTNYGMNWVRQAPGQGLEWMGWISTYTGETTYAEDFKGRFVFSLDTSVSTAYLQISSLKAEDTAVYYCEREGGVNNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTSPPC

SEQ ID NO: 464 - protein, 227 aa, Artificial Sequence
  tC terminal-modified AFD.v12 Heavy Chain
EVQLVQSGPELKKPGASVKVSCKASGYTFTNYGMNWVRQAPGQGLEWMGWINTYTGETTYAEDFKGRFVFSLDTSVSTAYLQISSLKAEDTAVYYCEREGGVDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTSPPC

SEQ ID NO: 465 - protein, 227 aa, Artificial Sequence
  C terminal-modified AFD.v13 Heavy Chain
EVQLVQSGPELKKPGASVKVSCKASGYTFTNYGMNWVRQAPGQGLEWMGWINTYTGETTYAEDFKGRFVFSLDTSVSTAYLQISSLKAEDTAVYYCEREGGVQNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTSPPC

SEQ ID NO: 466 - protein, 227 aa, Artificial Sequence
  C terminal-modified AFD.v14 Heavy Chain
EVQLVQSGPELKKPGASVKVSCKASGYTFTNYGMNWVRQAPGQGLEWMGWINTYTGETTYAEDFKGRFVFSLDTSVSTAYLQISSLKAEDTAVYYCEREGGVSNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTSPPC

SEQ ID NO: 467 - protein, 227 aa, Artificial Sequence; identical to SEQ ID NO: 466
  C terminal-modified AFD.v15 Heavy Chain

SEQ ID NO: 468 - protein, 227 aa, Artificial Sequence
  C terminal-modified huAFD.v2.0 Heavy Chain
EVQLVQSGAEVKKPGASVKVSCKASGYTFTSYYMYWVRQAPGQGLEWIGEINPTSGGTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTSPPC

SEQ ID NO: 469 - protein, 227 aa, Artificial Sequence; identical to SEQ ID NO: 468
  C terminal-modified huAFD.v2.1 Heavy Chain

SEQ ID NO: 470 - protein, 227 aa, Artificial Sequence
  C terminal-modified huAFD.v2.3 Heavy Chain
EVQLVQSGAEVKKPGASVKVSCKASGYTFTSYYMYWVRQAPGQGLEWIGEINPYSGDTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTSPPC

SEQ ID NO: 471 - protein, 227 aa, Artificial Sequence
  C terminal-modified huAFD.v1 Heavy Chain
EVQLVQSGAEVKKPGASVKVSCKASGYTFTSYYMYWVRQAPGQGLEWIGEINPTNGGTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTSPPC

SEQ ID NO: 472 - protein, 227 aa, Artificial Sequence
  C terminal-modified huAFD.v1.1 Heavy Chain
EVQLVQSGAEVKKPGASVKVSCKASGYTFTSYYMYWVRQAPGQGLEWIGEINPTQGGTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTSPPC

SEQ ID NO: 473 - protein, 227 aa, Artificial Sequence
  C terminal-modified huAFD.v2.2 Heavy Chain
EVQLVQSGAEVKKPGASVKVSCKASGYTFTSYYMYWVRQAPGQGLEWIGEINPTSGDTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTSPPC

SEQ ID NO: 474 - protein, 227 aa, Artificial Sequence
  C terminal-modified huAFD.v2.4 Heavy Chain
EVQLVQSGAEVKKPGASVKVSCKASGYTFTSYYMYWVRQAPGQGLEWIGEINPTSGETNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTSPPC

SEQ ID NO: 475 - protein, 227 aa, Artificial Sequence
  C terminal-modified huAFD.v2.5 Heavy Chain
EVQLVQSGAEVKKPGASVKVSCKASGYTFTSYYMYWVRQAPGQGLEWIGEINPYSGGTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTSPPC

SEQ ID NO: 476 - protein, 227 aa, Artificial Sequence; identical to SEQ ID NO: 468
  C terminal-modified huAFD.v2.6 Heavy Chain

SEQ ID NO: 477 - protein, 227 aa, Artificial Sequence; identical to SEQ ID NO: 468
  C terminal-modified huAFD.v2.7 Heavy Chain

SEQ ID NO: 478 - protein, 227 aa, Artificial Sequence; identical to SEQ ID NO: 468
  C terminal-modified huAFD.v2.8 Heavy Chain

SEQ ID NO: 479 - protein, 227 aa, Artificial Sequence
  C terminal-modified huAFD.v2.9 Heavy Chain
EVQLVQSGAEVKKPGASVKVSCKASGYTFTSYYMYWVRQAPGQGLEWIGWINPTSGGTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTSPPC

SEQ ID NO: 480 - protein, 227 aa, Artificial Sequence; identical to SEQ ID NO: 468
  C terminal-modified huAFD.v2.10 Heavy Chain

SEQ ID NO: 481 - protein, 227 aa, Artificial Sequence; identical to SEQ ID NO: 468
  C terminal-modified huAFD.v2.11 Heavy Chain

SEQ ID NO: 482 - protein, 227 aa, Artificial Sequence; identical to SEQ ID NO: 475
  C terminal-modified huAFD.v2.12 Heavy Chain

SEQ ID NO: 483 - protein, 227 aa, Artificial Sequence; identical to SEQ ID NO: 468
  C terminal-modified huAFD.v2.13 Heavy Chain

SEQ ID NO: 484 - protein, 227 aa, Artificial Sequence; identical to SEQ ID NO: 474
  C terminal-modified huAFD.v2.14 Heavy Chain

SEQ ID NO: 485 - protein, 227 aa, Artificial Sequence
  C terminal-modified huAFD.v2.15 Heavy Chain
EVQLVQSGAEVKKPGASVKVSCKASGYTFTSYYMYWVRQAPGQGLEWIGEINPYSGETNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTSPPC

SEQ ID NO: 486 - protein, 227 aa, Artificial Sequence
  C terminal-modified AFD-WT Heavy Chain
EVQLVQSGPELKKPGASVKVSCKASGYTFTNYGMNWVRQAPGQGLEWMGWINTYTGETTYADDFKGRFVFSLDTSVSTAYLQISSLKAEDTAVYYCEREGGVNNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTAPPC

SEQ ID NO: 487 - protein, 227 aa, Artificial Sequence; identical to SEQ ID NO: 486
  C terminal-modified AFD.v1 Heavy Chain

SEQ ID NO: 488 - protein, 227 aa, Artificial Sequence; identical to SEQ ID NO: 486
  C terminal-modified AFD.v2 Heavy Chain

SEQ ID NO: 489 - protein, 227 aa, Artificial Sequence; identical to SEQ ID NO: 486
  C terminal-modified AFD.v3 Heavy Chain

SEQ ID NO: 490 - protein, 227 aa, Artificial Sequence; identical to SEQ ID NO: 486
  C terminal-modified AFD.v4 Heavy Chain

SEQ ID NO: 491 - protein, 227 aa, Artificial Sequence; identical to SEQ ID NO: 486
  C terminal-modified AFD.v5 Heavy Chain

SEQ ID NO: 492 - protein, 227 aa, Artificial Sequence
  C terminal-modified AFD.v6 Heavy Chain
EVQLVQSGPELKKPGASVKVSCKASGYTFTNYGMNWVRQAPGQGLEWMGWINTYTGETTYAEDFKGRFVFSLDTSVSTAYLQISSLKAEDTAVYYCEREGGVNNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTAPPC

SEQ ID NO: 493 - protein, 227 aa, Artificial Sequence; identical to SEQ ID NO: 492
  C terminal-modified AFD.v7 Heavy Chain

SEQ ID NO: 494 - protein, 227 aa, Artificial Sequence; identical to SEQ ID NO: 492
  C terminal-modified AFD.v8 Heavy Chain

SEQ ID NO: 495 - protein, 227 aa, Artificial Sequence; identical to SEQ ID NO: 492
  C terminal-modified AFD.v9 Heavy Chain

SEQ ID NO: 496 - protein, 227 aa, Artificial Sequence; identical to SEQ ID NO: 492
  C terminal-modified AFD.v10 Heavy Chain

SEQ ID NO: 497 - protein, 227 aa, Artificial Sequence
  C terminal-modified AFD.v11 Heavy Chain
EVQLVQSGPELKKPGASVKVSCKASGYTFTNYGMNWVRQAPGQGLEWMGWISTYTGETTYAEDFKGRFVFSLDTSVSTAYLQISSLKAEDTAVYYCEREGGVNNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTAPPC

SEQ ID NO: 498 - protein, 227 aa, Artificial Sequence
  C terminal-modified AFD.v12 Heavy Chain
EVQLVQSGPELKKPGASVKVSCKASGYTFTNYGMNWVRQAPGQGLEWMGWINTYTGETTYAEDFKGRFVFSLDTSVSTAYLQISSLKAEDTAVYYCEREGGVDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTAPPC

SEQ ID NO: 499 - protein, 227 aa, Artificial Sequence
  C terminal-modified AFD.v13 Heavy Chain
EVQLVQSGPELKKPGASVKVSCKASGYTFTNYGMNWVRQAPGQGLEWMGWINTYTGETTYAEDFKGRFVFSLDTSVSTAYLQISSLKAEDTAVYYCEREGGVQNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTAPPC

SEQ ID NO: 500 - protein, 227 aa, Artificial Sequence
  C terminal-modified AFD.v14 Heavy Chain
EVQLVQSGPELKKPGASVKVSCKASGYTFTNYGMNWVRQAPGQGLEWMGWINTYTGETTYAEDFKGRFVFSLDTSVSTAYLQISSLKAEDTAVYYCEREGGVSNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTAPPC

SEQ ID NO: 501 - protein, 227 aa, Artificial Sequence; identical to SEQ ID NO: 500
  C terminal-modified AFD.v15 Heavy Chain

SEQ ID NO: 502 - protein, 227 aa, Artificial Sequence
  C terminal-modified huAFD.v2.0 Heavy Chain
EVQLVQSGAEVKKPGASVKVSCKASGYTFTSYYMYWVRQAPGQGLEWIGEINPTSGGTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTAPPC

SEQ ID NO: 503 - protein, 227 aa, Artificial Sequence; identical to SEQ ID NO: 502
  C terminal-modified huAFD.v2.1 Heavy Chain

SEQ ID NO: 504 - protein, 227 aa, Artificial Sequence
  C terminal-modified huAFD.v2.3 Heavy Chain
EVQLVQSGAEVKKPGASVKVSCKASGYTFTSYYMYWVRQAPGQGLEWIGEINPYSGDTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTAPPC

SEQ ID NO: 505 - protein, 227 aa, Artificial Sequence
  C terminal-modified huAFD.v1 Heavy Chain
EVQLVQSGAEVKKPGASVKVSCKASGYTFTSYYMYWVRQAPGQGLEWIGEINPTNGGTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTAPPC

SEQ ID NO: 506 - protein, 227 aa, Artificial Sequence
  C terminal-modified huAFD.v1.1 Heavy Chain
EVQLVQSGAEVKKPGASVKVSCKASGYTFTSYYMYWVRQAPGQGLEWIGEINPTQGGTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTAPPC

SEQ ID NO: 507 - protein, 227 aa, Artificial Sequence
  C terminal-modified huAFD.v2.2 Heavy Chain
EVQLVQSGAEVKKPGASVKVSCKASGYTFTSYYMYWVRQAPGQGLEWIGEINPTSGDTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTAPPC

SEQ ID NO: 508 - protein, 227 aa, Artificial Sequence
  C terminal-modified huAFD.v2.4 Heavy Chain
EVQLVQSGAEVKKPGASVKVSCKASGYTFTSYYMYWVRQAPGQGLEWIGEINPTSGETNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTAPPC

SEQ ID NO: 509 - protein, 227 aa, Artificial Sequence
  C terminal-modified huAFD.v2.5 Heavy Chain
EVQLVQSGAEVKKPGASVKVSCKASGYTFTSYYMYWVRQAPGQGLEWIGEINPYSGGTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTAPPC

SEQ ID NO: 510 - protein, 227 aa, Artificial Sequence; identical to SEQ ID NO: 502
  C terminal-modified huAFD.v2.6 Heavy Chain

SEQ ID NO: 511 - protein, 227 aa, Artificial Sequence; identical to SEQ ID NO: 502
  C terminal-modified huAFD.v2.7 Heavy Chain

SEQ ID NO: 512 - protein, 227 aa, Artificial Sequence; identical to SEQ ID NO: 502
  C terminal-modified huAFD.v2.8 Heavy Chain

SEQ ID NO: 513 - protein, 227 aa, Artificial Sequence
  C terminal-modified huAFD.v2.9 Heavy Chain
EVQLVQSGAEVKKPGASVKVSCKASGYTFTSYYMYWVRQAPGQGLEWIGWINPTSGGTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTAPPC

SEQ ID NO: 514 - protein, 227 aa, Artificial Sequence; identical to SEQ ID NO: 502
  C terminal-modified huAFD.v2.10 Heavy Chain

SEQ ID NO: 515 - protein, 227 aa, Artificial Sequence; identical to SEQ ID NO: 502
  C terminal-modified huAFD.v2.11 Heavy Chain

SEQ ID NO: 516 - protein, 227 aa, Artificial Sequence; identical to SEQ ID NO: 509
  C terminal-modified huAFD.v2.12 Heavy Chain

SEQ ID NO: 517 - protein, 227 aa, Artificial Sequence; identical to SEQ ID NO: 502
  C terminal-modified huAFD.v2.13 Heavy Chain

SEQ ID NO: 518 - protein, 227 aa, Artificial Sequence; identical to SEQ ID NO: 508
  C terminal-modified huAFD.v2.14 Heavy Chain

SEQ ID NO: 519 - protein, 227 aa, Artificial Sequence
  C terminal-modified huAFD.v2.15 Heavy Chain
EVQLVQSGAEVKKPGASVKVSCKASGYTFTSYYMYWVRQAPGQGLEWIGEINPYSGETNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTAPPC

SEQ ID NO: 520 - protein, 227 aa, Artificial Sequence
  C terminal-modified AFD-WT Heavy Chain
EVQLVQSGPELKKPGASVKVSCKASGYTFTNYGMNWVRQAPGQGLEWMGWINTYTGETTYADDFKGRFVFSLDTSVSTAYLQISSLKAEDTAVYYCEREGGVNNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTSGGC

SEQ ID NO: 521 - protein, 227 aa, Artificial Sequence; identical to SEQ ID NO: 520
  C terminal-modified AFD.v1 Heavy Chain

SEQ ID NO: 522 - protein, 227 aa, Artificial Sequence; identical to SEQ ID NO: 520
  C terminal-modified AFD.v2 Heavy Chain

SEQ ID NO: 523 - protein, 227 aa, Artificial Sequence; identical to SEQ ID NO: 520
  C terminal-modified AFD.v3 Heavy Chain

SEQ ID NO: 524 - protein, 227 aa, Artificial Sequence; identical to SEQ ID NO: 520
  C terminal-modified AFD.v4 Heavy Chain

SEQ ID NO: 525 - protein, 227 aa, Artificial Sequence; identical to SEQ ID NO: 520
  C terminal-modified AFD.v5 Heavy Chain

SEQ ID NO: 526 - protein, 227 aa, Artificial Sequence
  C terminal-modified AFD.v6 Heavy Chain
EVQLVQSGPELKKPGASVKVSCKASGYTFTNYGMNWVRQAPGQGLEWMGWINTYTGETTYAEDFKGRFVFSLDTSVSTAYLQISSLKAEDTAVYYCEREGGVNNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTSGGC

SEQ ID NO: 527 - protein, 227 aa, Artificial Sequence; identical to SEQ ID NO: 526
  C terminal-modified AFD.v7 Heavy Chain

SEQ ID NO: 528 - protein, 227 aa, Artificial Sequence; identical to SEQ ID NO: 526
  C terminal-modified AFD.v8 Heavy Chain

SEQ ID NO: 529 - protein, 227 aa, Artificial Sequence; identical to SEQ ID NO: 526
  C terminal-modified AFD.v9 Heavy Chain

SEQ ID NO: 530 - protein, 227 aa, Artificial Sequence; identical to SEQ ID NO: 526
  C terminal-modified AFD.v10 Heavy Chain

SEQ ID NO: 531 - protein, 227 aa, Artificial Sequence
  C terminal-modified AFD.v11 Heavy Chain
EVQLVQSGPELKKPGASVKVSCKASGYTFTNYGMNWVRQAPGQGLEWMGWISTYTGETTYAEDFKGRFVFSLDTSVSTAYLQISSLKAEDTAVYYCEREGGVNNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTSGGC

SEQ ID NO: 532 - protein, 227 aa, Artificial Sequence
  C terminal-modified AFD.v12 Heavy Chain
EVQLVQSGPELKKPGASVKVSCKASGYTFTNYGMNWVRQAPGQGLEWMGWINTYTGETTYAEDFKGRFVFSLDTSVSTAYLQISSLKAEDTAVYYCEREGGVDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTSGGC

SEQ ID NO: 533 - protein, 227 aa, Artificial Sequence
  C terminal-modified AFD.v13 Heavy Chain
EVQLVQSGPELKKPGASVKVSCKASGYTFTNYGMNWVRQAPGQGLEWMGWINTYTGETTYAEDFKGRFVFSLDTSVSTAYLQISSLKAEDTAVYYCEREGGVQNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTSGGC

SEQ ID NO: 534 - protein, 227 aa, Artificial Sequence
  C terminal-modified AFD.v14 Heavy Chain
EVQLVQSGPELKKPGASVKVSCKASGYTFTNYGMNWVRQAPGQGLEWMGWINTYTGETTYAEDFKGRFVFSLDTSVSTAYLQISSLKAEDTAVYYCEREGGVSNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTSGGC

SEQ ID NO: 535 - protein, 227 aa, Artificial Sequence; identical to SEQ ID NO: 534
  C terminal-modified AFD.v15 Heavy Chain

SEQ ID NO: 536 - protein, 227 aa, Artificial Sequence
  C terminal-modified huAFD.v2.0 Heavy Chain
EVQLVQSGAEVKKPGASVKVSCKASGYTFTSYYMYWVRQAPGQGLEWIGEINPTSGGTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTSGGC

SEQ ID NO: 537 - protein, 227 aa, Artificial Sequence; identical to SEQ ID NO: 536
  C terminal-modified huAFD.v2.1 Heavy Chain

SEQ ID NO: 538 - protein, 227 aa, Artificial Sequence
  C terminal-modified huAFD.v2.3 Heavy Chain
EVQLVQSGAEVKKPGASVKVSCKASGYTFTSYYMYWVRQAPGQGLEWIGEINPYSGDTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTSGGC

SEQ ID NO: 539 - protein, 227 aa, Artificial Sequence
  C terminal-modified huAFD.v1 Heavy Chain
EVQLVQSGAEVKKPGASVKVSCKASGYTFTSYYMYWVRQAPGQGLEWIGEINPTNGGTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTSGGC

SEQ ID NO: 540 - protein, 227 aa, Artificial Sequence
  C terminal-modified huAFD.v1.1 Heavy Chain
EVQLVQSGAEVKKPGASVKVSCKASGYTFTSYYMYWVRQAPGQGLEWIGEINPTQGGTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTSGGC

SEQ ID NO: 541 - protein, 227 aa, Artificial Sequence
  C terminal-modified huAFD.v2.2 Heavy Chain
EVQLVQSGAEVKKPGASVKVSCKASGYTFTSYYMYWVRQAPGQGLEWIGEINPTSGDTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTSGGC

SEQ ID NO: 542 - protein, 227 aa, Artificial Sequence
  C terminal-modified huAFD.v2.4 Heavy Chain
EVQLVQSGAEVKKPGASVKVSCKASGYTFTSYYMYWVRQAPGQGLEWIGEINPTSGETNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTSGGC

SEQ ID NO: 543 - protein, 227 aa, Artificial Sequence
  C terminal-modified huAFD.v2.5 Heavy Chain
EVQLVQSGAEVKKPGASVKVSCKASGYTFTSYYMYWVRQAPGQGLEWIGEINPYSGGTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTSGGC

SEQ ID NO: 544 - protein, 227 aa, Artificial Sequence; identical to SEQ ID NO: 536
  C terminal-modified huAFD.v2.6 Heavy Chain

SEQ ID NO: 545 - protein, 227 aa, Artificial Sequence; identical to SEQ ID NO: 536
  C terminal-modified huAFD.v2.7 Heavy Chain

SEQ ID NO: 546 - protein, 227 aa, Artificial Sequence; identical to SEQ ID NO: 536
  C terminal-modified huAFD.v2.8 Heavy Chain

SEQ ID NO: 547 - protein, 227 aa, Artificial Sequence
  C terminal-modified huAFD.v2.9 Heavy Chain
EVQLVQSGAEVKKPGASVKVSCKASGYTFTSYYMYWVRQAPGQGLEWIGWINPTSGGTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTSGGC

SEQ ID NO: 548 - protein, 227 aa, Artificial Sequence; identical to SEQ ID NO: 536
  C terminal-modified huAFD.v2.10 Heavy Chain

SEQ ID NO: 549 - protein, 227 aa, Artificial Sequence; identical to SEQ ID NO: 536
  C terminal-modified huAFD.v2.11 Heavy Chain

SEQ ID NO: 550 - protein, 227 aa, Artificial Sequence; identical to SEQ ID NO: 543
  C terminal-modified huAFD.v2.12 Heavy Chain

SEQ ID NO: 551 - protein, 227 aa, Artificial Sequence; identical to SEQ ID NO: 536
  C terminal-modified huAFD.v2.13 Heavy Chain

SEQ ID NO: 552 - protein, 227 aa, Artificial Sequence; identical to SEQ ID NO: 542
  C terminal-modified huAFD.v2.14 Heavy Chain

SEQ ID NO: 553 - protein, 227 aa, Artificial Sequence
  C terminal-modified huAFD.v2.15 Heavy Chain
EVQLVQSGAEVKKPGASVKVSCKASGYTFTSYYMYWVRQAPGQGLEWIGEINPYSGETNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTSGGC

SEQ ID NO: 554 - protein, 223 aa, Artificial Sequence
  C terminal-modified AFD-WT Heavy Chain
EVQLVQSGPELKKPGASVKVSCKASGYTFTNYGMNWVRQAPGQGLEWMGWINTYTGETTYADDFKGRFVFSLDTSVSTAYLQISSLKAEDTAVYYCEREGGVNNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCYGPPC

SEQ ID NO: 555 - protein, 223 aa, Artificial Sequence; identical to SEQ ID NO: 554
  C terminal-modified AFD.v1 Heavy Chain

SEQ ID NO: 556 - protein, 223 aa, Artificial Sequence; identical to SEQ ID NO: 554
  C terminal-modified AFD.v2 Heavy Chain

SEQ ID NO: 557 - protein, 223 aa, Artificial Sequence; identical to SEQ ID NO: 554
  C terminal-modified AFD.v3 Heavy Chain

SEQ ID NO: 558 - protein, 223 aa, Artificial Sequence; identical to SEQ ID NO: 554
  C terminal-modified AFD.v4 Heavy Chain

SEQ ID NO: 559 - protein, 223 aa, Artificial Sequence; identical to SEQ ID NO: 554
  C terminal-modified AFD.v5 Heavy Chain

SEQ ID NO: 560 - protein, 223 aa, Artificial Sequence
  C terminal-modified AFD.v6 Heavy Chain
EVQLVQSGPELKKPGASVKVSCKASGYTFTNYGMNWVRQAPGQGLEWMGWINTYTGETTYAEDFKGRFVFSLDTSVSTAYLQISSLKAEDTAVYYCEREGGVNNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCYGPPC

SEQ ID NO: 561 - protein, 223 aa, Artificial Sequence; identical to SEQ ID NO: 560
  C terminal-modified AFD.v7 Heavy Chain

SEQ ID NO: 562 - protein, 223 aa, Artificial Sequence; identical to SEQ ID NO: 560
  C terminal-modified AFD.v8 Heavy Chain

SEQ ID NO: 563 - protein, 223 aa, Artificial Sequence; identical to SEQ ID NO: 560
  C terminal-modified AFD.v9 Heavy Chain

SEQ ID NO: 564 - protein, 223 aa, Artificial Sequence; identical to SEQ ID NO: 560
  C terminal-modified AFD.v10 Heavy Chain

SEQ ID NO: 565 - protein, 223 aa, Artificial Sequence
  C terminal-modified AFD.v11 Heavy Chain
EVQLVQSGPELKKPGASVKVSCKASGYTFTNYGMNWVRQAPGQGLEWMGWISTYTGETTYAEDFKGRFVFSLDTSVSTAYLQISSLKAEDTAVYYCEREGGVNNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCYGPPC

SEQ ID NO: 566 - protein, 223 aa, Artificial Sequence
  C terminal-modified AFD.v12 Heavy Chain
EVQLVQSGPELKKPGASVKVSCKASGYTFTNYGMNWVRQAPGQGLEWMGWINTYTGETTYAEDFKGRFVFSLDTSVSTAYLQISSLKAEDTAVYYCEREGGVDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCYGPPC

SEQ ID NO: 567 - protein, 223 aa, Artificial Sequence
  C terminal-modified AFD.v13 Heavy Chain
EVQLVQSGPELKKPGASVKVSCKASGYTFTNYGMNWVRQAPGQGLEWMGWINTYTGETTYAEDFKGRFVFSLDTSVSTAYLQISSLKAEDTAVYYCEREGGVQNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCYGPPC

SEQ ID NO: 568 - protein, 223 aa, Artificial Sequence
  C terminal-modified AFD.v14 Heavy Chain
EVQLVQSGPELKKPGASVKVSCKASGYTFTNYGMNWVRQAPGQGLEWMGWINTYTGETTYAEDFKGRFVFSLDTSVSTAYLQISSLKAEDTAVYYCEREGGVSNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCYGPPC

SEQ ID NO: 569 - protein, 223 aa, Artificial Sequence; identical to SEQ ID NO: 568
  C terminal-modified AFD.v15 Heavy Chain

SEQ ID NO: 570 - protein, 223 aa, Artificial Sequence
  C terminal-modified huAFD.v2.0 Heavy Chain
EVQLVQSGAEVKKPGASVKVSCKASGYTFTSYYMYWVRQAPGQGLEWIGEINPTSGGTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCYGPPC

SEQ ID NO: 571 - protein, 223 aa, Artificial Sequence; identical to SEQ ID NO: 570
  C terminal-modified huAFD.v2.1 Heavy Chain

SEQ ID NO: 572 - protein, 223 aa, Artificial Sequence
  C terminal-modified huAFD.v2.3 Heavy Chain
EVQLVQSGAEVKKPGASVKVSCKASGYTFTSYYMYWVRQAPGQGLEWIGEINPYSGDTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCYGPPC

SEQ ID NO: 573 - protein, 223 aa, Artificial Sequence
  C terminal-modified huAFD.v1 Heavy Chain
EVQLVQSGAEVKKPGASVKVSCKASGYTFTSYYMYWVRQAPGQGLEWIGEINPTNGGTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCYGPPC

SEQ ID NO: 574 - protein, 223 aa, Artificial Sequence
  C terminal-modified huAFD.v1.1 Heavy Chain
EVQLVQSGAEVKKPGASVKVSCKASGYTFTSYYMYWVRQAPGQGLEWIGEINPTQGGTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCYGPPC

SEQ ID NO: 575 - protein, 223 aa, Artificial Sequence
  C terminal-modified huAFD.v2.2 Heavy Chain
EVQLVQSGAEVKKPGASVKVSCKASGYTFTSYYMYWVRQAPGQGLEWIGEINPTSGDTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCYGPPC

SEQ ID NO: 576 - protein, 223 aa, Artificial Sequence
  C terminal-modified huAFD.v2.4 Heavy Chain
EVQLVQSGAEVKKPGASVKVSCKASGYTFTSYYMYWVRQAPGQGLEWIGEINPTSGETNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCYGPPC

SEQ ID NO: 577 - protein, 223 aa, Artificial Sequence
  C terminal-modified huAFD.v2.5 Heavy Chain
EVQLVQSGAEVKKPGASVKVSCKASGYTFTSYYMYWVRQAPGQGLEWIGEINPYSGGTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCYGPPC

SEQ ID NO: 578 - protein, 223 aa, Artificial Sequence; identical to SEQ ID NO: 570
  C terminal-modified huAFD.v2.6 Heavy Chain

SEQ ID NO: 579 - protein, 223 aa, Artificial Sequence; identical to SEQ ID NO: 570
  C terminal-modified huAFD.v2.7 Heavy Chain

SEQ ID NO: 580 - protein, 223 aa, Artificial Sequence; identical to SEQ ID NO: 570
  C terminal-modified huAFD.v2.8 Heavy Chain

SEQ ID NO: 581 - protein, 223 aa, Artificial Sequence
  C terminal-modified huAFD.v2.9 Heavy Chain
EVQLVQSGAEVKKPGASVKVSCKASGYTFTSYYMYWVRQAPGQGLEWIGWINPTSGGTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCYGPPC

SEQ ID NO: 582 - protein, 223 aa, Artificial Sequence; identical to SEQ ID NO: 570
  C terminal-modified huAFD.v2.10 Heavy Chain

SEQ ID NO: 583 - protein, 223 aa, Artificial Sequence; identical to SEQ ID NO: 570
  C terminal-modified huAFD.v2.11 Heavy Chain

SEQ ID NO: 584 - protein, 223 aa, Artificial Sequence; identical to SEQ ID NO: 577
  C terminal-modified huAFD.v2.12 Heavy Chain

SEQ ID NO: 585 - protein, 223 aa, Artificial Sequence; identical to SEQ ID NO: 570
  C terminal-modified huAFD.v2.13 Heavy Chain

SEQ ID NO: 586 - protein, 223 aa, Artificial Sequence; identical to SEQ ID NO: 576
  C terminal-modified huAFD.v2.14 Heavy Chain

SEQ ID NO: 587 - protein, 223 aa, Artificial Sequence
  C terminal-modified huAFD.v2.15 Heavy Chain
EVQLVQSGAEVKKPGASVKVSCKASGYTFTSYYMYWVRQAPGQGLEWIGEINPYSGETNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCYGPPC

SEQ ID NO: 588 - protein, 221 aa, Artificial Sequence
  C terminal-modified AFD-WT Heavy Chain
EVQLVQSGPELKKPGASVKVSCKASGYTFTNYGMNWVRQAPGQGLEWMGWINTYTGETTYADDFKGRFVFSLDTSVSTAYLQISSLKAEDTAVYYCEREGGVNNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSVERK

SEQ ID NO: 589 - protein, 221 aa, Artificial Sequence; identical to SEQ ID NO: 588
  C terminal-modified AFD.v1 Heavy Chain

SEQ ID NO: 590 - protein, 221 aa, Artificial Sequence; identical to SEQ ID NO: 588
  C terminal-modified AFD.v2 Heavy Chain

SEQ ID NO: 591 - protein, 221 aa, Artificial Sequence; identical to SEQ ID NO: 588
  C terminal-modified AFD.v3 Heavy Chain

SEQ ID NO: 592 - protein, 221 aa, Artificial Sequence; identical to SEQ ID NO: 588
  C terminal-modified AFD.v4 Heavy Chain

SEQ ID NO: 593 - protein, 221 aa, Artificial Sequence; identical to SEQ ID NO: 588
  C terminal-modified AFD.v5 Heavy Chain

SEQ ID NO: 594 - protein, 221 aa, Artificial Sequence
  C terminal-modified AFD.v6 Heavy Chain
EVQLVQSGPELKKPGASVKVSCKASGYTFTNYGMNWVRQAPGQGLEWMGWINTYTGETTYAEDFKGRFVFSLDTSVSTAYLQISSLKAEDTAVYYCEREGGVNNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSVERK

SEQ ID NO: 595 - protein, 221 aa, Artificial Sequence; identical to SEQ ID NO: 594
  C terminal-modified AFD.v7 Heavy Chain

SEQ ID NO: 596 - protein, 221 aa, Artificial Sequence; identical to SEQ ID NO: 594
  C terminal-modified AFD.v8 Heavy Chain

SEQ ID NO: 597 - protein, 221 aa, Artificial Sequence; identical to SEQ ID NO: 594
  C terminal-modified AFD.v9 Heavy Chain

SEQ ID NO: 598 - protein, 221 aa, Artificial Sequence; identical to SEQ ID NO: 594
  C terminal-modified AFD.v10 Heavy Chain

SEQ ID NO: 599 - protein, 221 aa, Artificial Sequence
  C terminal-modified AFD.v11 Heavy Chain
EVQLVQSGPELKKPGASVKVSCKASGYTFTNYGMNWVRQAPGQGLEWMGWISTYTGETTYAEDFKGRFVFSLDTSVSTAYLQISSLKAEDTAVYYCEREGGVNNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSVERK

SEQ ID NO: 600 - protein, 221 aa, Artificial Sequence
  C terminal-modified AFD.v12 Heavy Chain
EVQLVQSGPELKKPGASVKVSCKASGYTFTNYGMNWVRQAPGQGLEWMGWINTYTGETTYAEDFKGRFVFSLDTSVSTAYLQISSLKAEDTAVYYCEREGGVDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSVERK

SEQ ID NO: 601 - protein, 221 aa, Artificial Sequence
  C terminal-modified AFD.v13 Heavy Chain
EVQLVQSGPELKKPGASVKVSCKASGYTFTNYGMNWVRQAPGQGLEWMGWINTYTGETTYAEDFKGRFVFSLDTSVSTAYLQISSLKAEDTAVYYCEREGGVQNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSVERK

SEQ ID NO: 602 - protein, 221 aa, Artificial Sequence
  C terminal-modified AFD.v14 Heavy Chain
EVQLVQSGPELKKPGASVKVSCKASGYTFTNYGMNWVRQAPGQGLEWMGWINTYTGETTYAEDFKGRFVFSLDTSVSTAYLQISSLKAEDTAVYYCEREGGVSNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSVERK

SEQ ID NO: 603 - protein, 221 aa, Artificial Sequence; identical to SEQ ID NO: 602
  C terminal-modified AFD.v15 Heavy Chain

SEQ ID NO: 604 - protein, 221 aa, Artificial Sequence
  C terminal-modified huAFD.v2.0 Heavy Chain
EVQLVQSGAEVKKPGASVKVSCKASGYTFTSYYMYWVRQAPGQGLEWIGEINPTSGGTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSVERK

SEQ ID NO: 605 - protein, 221 aa, Artificial Sequence; identical to SEQ ID NO: 604
  C terminal-modified huAFD.v2.1 Heavy Chain

SEQ ID NO: 606 - protein, 221 aa, Artificial Sequence
  C terminal-modified huAFD.v2.3 Heavy Chain
EVQLVQSGAEVKKPGASVKVSCKASGYTFTSYYMYWVRQAPGQGLEWIGEINPYSGDTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSVERK

SEQ ID NO: 607 - protein, 221 aa, Artificial Sequence
  C terminal-modified huAFD.v1 Heavy Chain
EVQLVQSGAEVKKPGASVKVSCKASGYTFTSYYMYWVRQAPGQGLEWIGEINPTNGGTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSVERK

SEQ ID NO: 608 - protein, 221 aa, Artificial Sequence
  C terminal-modified huAFD.v1.1 Heavy Chain
EVQLVQSGAEVKKPGASVKVSCKASGYTFTSYYMYWVRQAPGQGLEWIGEINPTQGGTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSVERK

SEQ ID NO: 609 - protein, 221 aa, Artificial Sequence
  C terminal-modified huAFD.v2.2 Heavy Chain
EVQLVQSGAEVKKPGASVKVSCKASGYTFTSYYMYWVRQAPGQGLEWIGEINPTSGDTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSVERK

SEQ ID NO: 610 - protein, 221 aa, Artificial Sequence
  C terminal-modified huAFD.v2.4 Heavy Chain
EVQLVQSGAEVKKPGASVKVSCKASGYTFTSYYMYWVRQAPGQGLEWIGEINPTSGETNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSVERK

SEQ ID NO: 611 - protein, 221 aa, Artificial Sequence
  C terminal-modified huAFD.v2.5 Heavy Chain
EVQLVQSGAEVKKPGASVKVSCKASGYTFTSYYMYWVRQAPGQGLEWIGEINPYSGGTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSVERK

SEQ ID NO: 612 - protein, 221 aa, Artificial Sequence; identical to SEQ ID NO: 604
  C terminal-modified huAFD.v2.6 Heavy Chain

SEQ ID NO: 613 - protein, 221 aa, Artificial Sequence; identical to SEQ ID NO: 604
  C terminal-modified huAFD.v2.7 Heavy Chain

SEQ ID NO: 614 - protein, 221 aa, Artificial Sequence; identical to SEQ ID NO: 604
  C terminal-modified huAFD.v2.8 Heavy Chain

SEQ ID NO: 615 - protein, 221 aa, Artificial Sequence
  C terminal-modified huAFD.v2.9 Heavy Chain
EVQLVQSGAEVKKPGASVKVSCKASGYTFTSYYMYWVRQAPGQGLEWIGWINPTSGGTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSVERK

SEQ ID NO: 616 - protein, 221 aa, Artificial Sequence; identical to SEQ ID NO: 604
  C terminal-modified huAFD.v2.10 Heavy Chain

SEQ ID NO: 617 - protein, 221 aa, Artificial Sequence; identical to SEQ ID NO: 604
  C terminal-modified huAFD.v2.11 Heavy Chain

SEQ ID NO: 618 - protein, 221 aa, Artificial Sequence; identical to SEQ ID NO: 611
  C terminal-modified huAFD.v2.12 Heavy Chain

SEQ ID NO: 619 - protein, 221 aa, Artificial Sequence; identical to SEQ ID NO: 604
  C terminal-modified huAFD.v2.13 Heavy Chain

SEQ ID NO: 620 - protein, 221 aa, Artificial Sequence; identical to SEQ ID NO: 610
  C terminal-modified huAFD.v2.14 Heavy Chain

SEQ ID NO: 621 - protein, 221 aa, Artificial Sequence
  C terminal-modified huAFD.v2.15 Heavy Chain
EVQLVQSGAEVKKPGASVKVSCKASGYTFTSYYMYWVRQAPGQGLEWIGEINPYSGETNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSVERK

SEQ ID NO: 622 - protein, 222 aa, Artificial Sequence
  C terminal-modified AFD-WT Heavy Chain
EVQLVQSGPELKKPGASVKVSCKASGYTFTNYGMNWVRQAPGQGLEWMGWINTYTGETTYADDFKGRFVFSLDTSVSTAYLQISSLKAEDTAVYYCEREGGVNNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSVERKC

SEQ ID NO: 623 - protein, 222 aa, Artificial Sequence; identical to SEQ ID NO: 622
  C terminal-modified AFD.v1 Heavy Chain

SEQ ID NO: 624 - protein, 222 aa, Artificial Sequence; identical to SEQ ID NO: 622
  C terminal-modified AFD.v2 Heavy Chain

SEQ ID NO: 625 - protein, 222 aa, Artificial Sequence; identical to SEQ ID NO: 622
  C terminal-modified AFD.v3 Heavy Chain

SEQ ID NO: 626 - protein, 222 aa, Artificial Sequence; identical to SEQ ID NO: 622
  C terminal-modified AFD.v4 Heavy Chain

SEQ ID NO: 627 - protein, 222 aa, Artificial Sequence; identical to SEQ ID NO: 622
  C terminal-modified AFD.v5 Heavy Chain

SEQ ID NO: 628 - protein, 222 aa, Artificial Sequence
  C terminal-modified AFD.v6 Heavy Chain
EVQLVQSGPELKKPGASVKVSCKASGYTFTNYGMNWVRQAPGQGLEWMGWINTYTGETTYAEDFKGRFVFSLDTSVSTAYLQISSLKAEDTAVYYCEREGGVNNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSVERKC

SEQ ID NO: 629 - protein, 222 aa, Artificial Sequence; identical to SEQ ID NO: 628
  C terminal-modified AFD.v7 Heavy Chain

SEQ ID NO: 630 - protein, 222 aa, Artificial Sequence; identical to SEQ ID NO: 628
  C terminal-modified AFD.v8 Heavy Chain

SEQ ID NO: 631 - protein, 222 aa, Artificial Sequence; identical to SEQ ID NO: 628
  C terminal-modified AFD.v9 Heavy Chain

SEQ ID NO: 632 - protein, 222 aa, Artificial Sequence; identical to SEQ ID NO: 628
  C terminal-modified AFD.v10 Heavy Chain

SEQ ID NO: 633 - protein, 222 aa, Artificial Sequence
  C terminal-modified AFD.v11 Heavy Chain
EVQLVQSGPELKKPGASVKVSCKASGYTFTNYGMNWVRQAPGQGLEWMGWISTYTGETTYAEDFKGRFVFSLDTSVSTAYLQISSLKAEDTAVYYCEREGGVNNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSVERKC

SEQ ID NO: 634 - protein, 222 aa, Artificial Sequence
  C terminal-modified AFD.v12 Heavy Chain
EVQLVQSGPELKKPGASVKVSCKASGYTFTNYGMNWVRQAPGQGLEWMGWINTYTGETTYAEDFKGRFVFSLDTSVSTAYLQISSLKAEDTAVYYCEREGGVDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSVERKC

SEQ ID NO: 635 - protein, 222 aa, Artificial Sequence
  C terminal-modified AFD.v13 Heavy Chain
EVQLVQSGPELKKPGASVKVSCKASGYTFTNYGMNWVRQAPGQGLEWMGWINTYTGETTYAEDFKGRFVFSLDTSVSTAYLQISSLKAEDTAVYYCEREGGVQNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSVERKC

SEQ ID NO: 636 - protein, 222 aa, Artificial Sequence
  C terminal-modified AFD.v14 Heavy Chain
EVQLVQSGPELKKPGASVKVSCKASGYTFTNYGMNWVRQAPGQGLEWMGWINTYTGETTYAEDFKGRFVFSLDTSVSTAYLQISSLKAEDTAVYYCEREGGVSNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSVERKC

SEQ ID NO: 637 - protein, 222 aa, Artificial Sequence; identical to SEQ ID NO: 636
  C terminal-modified AFD.v15 Heavy Chain

SEQ ID NO: 638 - protein, 222 aa, Artificial Sequence
  C terminal-modified huAFD.v2.0 Heavy Chain
EVQLVQSGAEVKKPGASVKVSCKASGYTFTSYYMYWVRQAPGQGLEWIGEINPTSGGTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSVERKC

SEQ ID NO: 639 - protein, 222 aa, Artificial Sequence; identical to SEQ ID NO: 638
  C terminal-modified huAFD.v2.1 Heavy Chain

SEQ ID NO: 640 - protein, 222 aa, Artificial Sequence
  C terminal-modified huAFD.v2.3 Heavy Chain
EVQLVQSGAEVKKPGASVKVSCKASGYTFTSYYMYWVRQAPGQGLEWIGEINPYSGDTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSVERKC

SEQ ID NO: 641 - protein, 222 aa, Artificial Sequence
  C terminal-modified huAFD.v1 Heavy Chain
EVQLVQSGAEVKKPGASVKVSCKASGYTFTSYYMYWVRQAPGQGLEWIGEINPTNGGTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSVERKC

SEQ ID NO: 642 - protein, 222 aa, Artificial Sequence
  C terminal-modified huAFD.v1.1 Heavy Chain
EVQLVQSGAEVKKPGASVKVSCKASGYTFTSYYMYWVRQAPGQGLEWIGEINPTQGGTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSVERKC

SEQ ID NO: 643 - protein, 222 aa, Artificial Sequence
  C terminal-modified huAFD.v2.2 Heavy Chain
EVQLVQSGAEVKKPGASVKVSCKASGYTFTSYYMYWVRQAPGQGLEWIGEINPTSGDTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSVERKC

SEQ ID NO: 644 - protein, 222 aa, Artificial Sequence
  C terminal-modified huAFD.v2.4 Heavy Chain
EVQLVQSGAEVKKPGASVKVSCKASGYTFTSYYMYWVRQAPGQGLEWIGEINPTSGETNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSVERKC

SEQ ID NO: 645 - protein, 222 aa, Artificial Sequence
  C terminal-modified huAFD.v2.5 Heavy Chain
EVQLVQSGAEVKKPGASVKVSCKASGYTFTSYYMYWVRQAPGQGLEWIGEINPYSGGTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSVERKC

SEQ ID NO: 646 - protein, 222 aa, Artificial Sequence; identical to SEQ ID NO: 638
  C terminal-modified huAFD.v2.6 Heavy Chain

SEQ ID NO: 647 - protein, 222 aa, Artificial Sequence; identical to SEQ ID NO: 638
  C terminal-modified huAFD.v2.7 Heavy Chain

SEQ ID NO: 648 - protein, 222 aa, Artificial Sequence; identical to SEQ ID NO: 638
  C terminal-modified huAFD.v2.8 Heavy Chain

SEQ ID NO: 649 - protein, 222 aa, Artificial Sequence
  C terminal-modified huAFD.v2.9 Heavy Chain
EVQLVQSGAEVKKPGASVKVSCKASGYTFTSYYMYWVRQAPGQGLEWIGWINPTSGGTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSVERKC

SEQ ID NO: 650 - protein, 222 aa, Artificial Sequence; identical to SEQ ID NO: 638
  C terminal-modified huAFD.v2.10 Heavy Chain

SEQ ID NO: 651 - protein, 222 aa, Artificial Sequence; identical to SEQ ID NO: 638
  C terminal-modified huAFD.v2.11 Heavy Chain

SEQ ID NO: 652 - protein, 222 aa, Artificial Sequence; identical to SEQ ID NO: 645
  C terminal-modified huAFD.v2.12 Heavy Chain

SEQ ID NO: 653 - protein, 222 aa, Artificial Sequence; identical to SEQ ID NO: 638
  C terminal-modified huAFD.v2.13 Heavy Chain

SEQ ID NO: 654 - protein, 222 aa, Artificial Sequence; identical to SEQ ID NO: 644
  C terminal-modified huAFD.v2.14 Heavy Chain

SEQ ID NO: 655 - protein, 222 aa, Artificial Sequence
  C terminal-modified huAFD.v2.15 Heavy Chain
EVQLVQSGAEVKKPGASVKVSCKASGYTFTSYYMYWVRQAPGQGLEWIGEINPYSGETNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSVERKC

SEQ ID NO: 656 - protein, 223 aa, Artificial Sequence
  C terminal-modified AFD-WT Heavy Chain
EVQLVQSGPELKKPGASVKVSCKASGYTFTNYGMNWVRQAPGQGLEWMGWINTYTGETTYADDFKGRFVFSLDTSVSTAYLQISSLKAEDTAVYYCEREGGVNNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSKYGPPC

SEQ ID NO: 657 - protein, 223 aa, Artificial Sequence; identical to SEQ ID NO: 656
  C terminal-modified AFD.v1 Heavy Chain

SEQ ID NO: 658 - protein, 223 aa, Artificial Sequence; identical to SEQ ID NO: 656
  C terminal-modified AFD.v2 Heavy Chain

SEQ ID NO: 659 - protein, 223 aa, Artificial Sequence; identical to SEQ ID NO: 656
  C terminal-modified AFD.v3 Heavy Chain

SEQ ID NO: 660 - protein, 223 aa, Artificial Sequence; identical to SEQ ID NO: 656
  C terminal-modified AFD.v4 Heavy Chain

SEQ ID NO: 661 - protein, 223 aa, Artificial Sequence; identical to SEQ ID NO: 656
  C terminal-modified AFD.v5 Heavy Chain

SEQ ID NO: 662 - protein, 223 aa, Artificial Sequence
  C terminal-modified AFD.v6 Heavy Chain
EVQLVQSGPELKKPGASVKVSCKASGYTFTNYGMNWVRQAPGQGLEWMGWINTYTGETTYAEDFKGRFVFSLDTSVSTAYLQISSLKAEDTAVYYCEREGGVNNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSKYGPPC

SEQ ID NO: 663 - protein, 223 aa, Artificial Sequence; identical to SEQ ID NO: 662
  C terminal-modified AFD.v7 Heavy Chain

SEQ ID NO: 664 - protein, 223 aa, Artificial Sequence; identical to SEQ ID NO: 662
  C terminal-modified AFD.v8 Heavy Chain

SEQ ID NO: 665 - protein, 223 aa, Artificial Sequence; identical to SEQ ID NO: 662
  C terminal-modified AFD.v9 Heavy Chain

SEQ ID NO: 666 - protein, 223 aa, Artificial Sequence; identical to SEQ ID NO: 662
  C terminal-modified AFD.v10 Heavy Chain

SEQ ID NO: 667 - protein, 223 aa, Artificial Sequence
  C terminal-modified AFD.v11 Heavy Chain
EVQLVQSGPELKKPGASVKVSCKASGYTFTNYGMNWVRQAPGQGLEWMGWISTYTGETTYAEDFKGRFVFSLDTSVSTAYLQISSLKAEDTAVYYCEREGGVNNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSKYGPPC

SEQ ID NO: 668 - protein, 223 aa, Artificial Sequence
  C terminal-modified AFD.v12 Heavy Chain
EVQLVQSGPELKKPGASVKVSCKASGYTFTNYGMNWVRQAPGQGLEWMGWINTYTGETTYAEDFKGRFVFSLDTSVSTAYLQISSLKAEDTAVYYCEREGGVDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSKYGPPC

SEQ ID NO: 669 - protein, 223 aa, Artificial Sequence
  C terminal-modified AFD.v13 Heavy Chain
EVQLVQSGPELKKPGASVKVSCKASGYTFTNYGMNWVRQAPGQGLEWMGWINTYTGETTYAEDFKGRFVFSLDTSVSTAYLQISSLKAEDTAVYYCEREGGVQNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSKYGPPC

SEQ ID NO: 670 - protein, 223 aa, Artificial Sequence
  C terminal-modified AFD.v14 Heavy Chain
EVQLVQSGPELKKPGASVKVSCKASGYTFTNYGMNWVRQAPGQGLEWMGWINTYTGETTYAEDFKGRFVFSLDTSVSTAYLQISSLKAEDTAVYYCEREGGVSNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSKYGPPC

SEQ ID NO: 671 - protein, 223 aa, Artificial Sequence; identical to SEQ ID NO: 670
  C terminal-modified AFD.v15 Heavy Chain

SEQ ID NO: 672 - protein, 223 aa, Artificial Sequence
  C terminal-modified huAFD.v2.0 Heavy Chain
EVQLVQSGAEVKKPGASVKVSCKASGYTFTSYYMYWVRQAPGQGLEWIGEINPTSGGTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSKYGPPC

SEQ ID NO: 673 - protein, 223 aa, Artificial Sequence; identical to SEQ ID NO: 672
  C terminal-modified huAFD.v2.1 Heavy Chain

SEQ ID NO: 674 - protein, 223 aa, Artificial Sequence
  C terminal-modified huAFD.v2.3 Heavy Chain
EVQLVQSGAEVKKPGASVKVSCKASGYTFTSYYMYWVRQAPGQGLEWIGEINPYSGDTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSKYGPPC

SEQ ID NO: 675 - protein, 223 aa, Artificial Sequence
  C terminal-modified huAFD.v1 Heavy Chain
EVQLVQSGAEVKKPGASVKVSCKASGYTFTSYYMYWVRQAPGQGLEWIGEINPTNGGTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSKYGPPC

SEQ ID NO: 676 - protein, 223 aa, Artificial Sequence
  C terminal-modified huAFD.v1.1 Heavy Chain
EVQLVQSGAEVKKPGASVKVSCKASGYTFTSYYMYWVRQAPGQGLEWIGEINPTQGGTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSKYGPPC

SEQ ID NO: 677 - protein, 223 aa, Artificial Sequence
  C terminal-modified huAFD.v2.2 Heavy Chain
EVQLVQSGAEVKKPGASVKVSCKASGYTFTSYYMYWVRQAPGQGLEWIGEINPTSGDTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSKYGPPC

SEQ ID NO: 678 - protein, 223 aa, Artificial Sequence
  C terminal-modified huAFD.v2.4 Heavy Chain
EVQLVQSGAEVKKPGASVKVSCKASGYTFTSYYMYWVRQAPGQGLEWIGEINPTSGETNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSKYGPPC

SEQ ID NO: 679 - protein, 223 aa, Artificial Sequence
  C terminal-modified huAFD.v2.5 Heavy Chain
EVQLVQSGAEVKKPGASVKVSCKASGYTFTSYYMYWVRQAPGQGLEWIGEINPYSGGTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSKYGPPC

SEQ ID NO: 680 - protein, 223 aa, Artificial Sequence; identical to SEQ ID NO: 672
  C terminal-modified huAFD.v2.6 Heavy Chain

SEQ ID NO: 681 - protein, 223 aa, Artificial Sequence; identical to SEQ ID NO: 672
  C terminal-modified huAFD.v2.7 Heavy Chain

SEQ ID NO: 682 - protein, 223 aa, Artificial Sequence; identical to SEQ ID NO: 672
  C terminal-modified huAFD.v2.8 Heavy Chain

SEQ ID NO: 683 - protein, 223 aa, Artificial Sequence
  C terminal-modified huAFD.v2.9 Heavy Chain
EVQLVQSGAEVKKPGASVKVSCKASGYTFTSYYMYWVRQAPGQGLEWIGWINPTSGGTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSKYGPPC

SEQ ID NO: 684 - protein, 223 aa, Artificial Sequence; identical to SEQ ID NO: 672
  C terminal-modified huAFD.v2.10 Heavy Chain

SEQ ID NO: 685 - protein, 223 aa, Artificial Sequence; identical to SEQ ID NO: 672
  C terminal-modified huAFD.v2.11 Heavy Chain

SEQ ID NO: 686 - protein, 223 aa, Artificial Sequence; identical to SEQ ID NO: 679
  C terminal-modified huAFD.v2.12 Heavy Chain

SEQ ID NO: 687 - protein, 223 aa, Artificial Sequence; identical to SEQ ID NO: 672
  C terminal-modified huAFD.v2.13 Heavy Chain

SEQ ID NO: 688 - protein, 223 aa, Artificial Sequence; identical to SEQ ID NO: 678
  C terminal-modified huAFD.v2.14 Heavy Chain

SEQ ID NO: 689 - protein, 223 aa, Artificial Sequence
  C terminal-modified huAFD.v2.15 Heavy Chain
EVQLVQSGAEVKKPGASVKVSCKASGYTFTSYYMYWVRQAPGQGLEWIGEINPYSGETNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSKYGPPC

SEQ ID NO: 690 - protein, 222 aa, Artificial Sequence
  C terminal-modified AFD-WT Heavy Chain
EVQLVQSGPELKKPGASVKVSCKASGYTFTNYGMNWVRQAPGQGLEWMGWINTYTGETTYADDFKGRFVFSLDTSVSTAYLQISSLKAEDTAVYYCEREGGVNNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSKYGPP

SEQ ID NO: 691 - protein, 222 aa, Artificial Sequence; identical to SEQ ID NO: 690
  C terminal-modified AFD.v1 Heavy Chain

SEQ ID NO: 692 - protein, 222 aa, Artificial Sequence; identical to SEQ ID NO: 690
  C terminal-modified AFD.v2 Heavy Chain

SEQ ID NO: 693 - protein, 222 aa, Artificial Sequence; identical to SEQ ID NO: 690
  C terminal-modified AFD.v3 Heavy Chain

SEQ ID NO: 694 - protein, 222 aa, Artificial Sequence; identical to SEQ ID NO: 690
  C terminal-modified AFD.v4 Heavy Chain

SEQ ID NO: 695 - protein, 222 aa, Artificial Sequence; identical to SEQ ID NO: 690
  C terminal-modified AFD.v5 Heavy Chain

SEQ ID NO: 696 - protein, 222 aa, Artificial Sequence
  C terminal-modified AFD.v6 Heavy Chain
EVQLVQSGPELKKPGASVKVSCKASGYTFTNYGMNWVRQAPGQGLEWMGWINTYTGETTYAEDFKGRFVFSLDTSVSTAYLQISSLKAEDTAVYYCEREGGVNNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSKYGPP

SEQ ID NO: 697 - protein, 222 aa, Artificial Sequence; identical to SEQ ID NO: 696
  C terminal-modified AFD.v7 Heavy Chain

SEQ ID NO: 698 - protein, 222 aa, Artificial Sequence; identical to SEQ ID NO: 696
  C terminal-modified AFD.v8 Heavy Chain

SEQ ID NO: 699 - protein, 222 aa, Artificial Sequence; identical to SEQ ID NO: 696
  C terminal-modified AFD.v9 Heavy Chain

SEQ ID NO: 700 - protein, 222 aa, Artificial Sequence; identical to SEQ ID NO: 696
  C terminal-modified AFD.v10 Heavy Chain

SEQ ID NO: 701 - protein, 222 aa, Artificial Sequence
  C terminal-modified AFD.v11 Heavy Chain
EVQLVQSGPELKKPGASVKVSCKASGYTFTNYGMNWVRQAPGQGLEWMGWISTYTGETTYAEDFKGRFVFSLDTSVSTAYLQISSLKAEDTAVYYCEREGGVNNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSKYGPP

SEQ ID NO: 702 - protein, 222 aa, Artificial Sequence
  C terminal-modified AFD.v12 Heavy Chain
EVQLVQSGPELKKPGASVKVSCKASGYTFTNYGMNWVRQAPGQGLEWMGWINTYTGETTYAEDFKGRFVFSLDTSVSTAYLQISSLKAEDTAVYYCEREGGVDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSKYGPP

SEQ ID NO: 703 - protein, 222 aa, Artificial Sequence
  C terminal-modified AFD.v13 Heavy Chain
EVQLVQSGPELKKPGASVKVSCKASGYTFTNYGMNWVRQAPGQGLEWMGWINTYTGETTYAEDFKGRFVFSLDTSVSTAYLQISSLKAEDTAVYYCEREGGVQNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSKYGPP

SEQ ID NO: 704 - protein, 222 aa, Artificial Sequence
  C terminal-modified AFD.v14 Heavy Chain
EVQLVQSGPELKKPGASVKVSCKASGYTFTNYGMNWVRQAPGQGLEWMGWINTYTGETTYAEDFKGRFVFSLDTSVSTAYLQISSLKAEDTAVYYCEREGGVSNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSKYGPP

SEQ ID NO: 705 - protein, 222 aa, Artificial Sequence; identical to SEQ ID NO: 704
  C terminal-modified AFD.v15 Heavy Chain

SEQ ID NO: 706 - protein, 222 aa, Artificial Sequence
  C terminal-modified huAFD.v2.0 Heavy Chain
EVQLVQSGAEVKKPGASVKVSCKASGYTFTSYYMYWVRQAPGQGLEWIGEINPTSGGTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSKYGPP

SEQ ID NO: 707 - protein, 222 aa, Artificial Sequence; identical to SEQ ID NO: 706
  C terminal-modified huAFD.v2.1 Heavy Chain

SEQ ID NO: 708 - protein, 222 aa, Artificial Sequence
  C terminal-modified huAFD.v2.3 Heavy Chain
EVQLVQSGAEVKKPGASVKVSCKASGYTFTSYYMYWVRQAPGQGLEWIGEINPYSGDTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSKYGPP

SEQ ID NO: 709 - protein, 222 aa, Artificial Sequence
  C terminal-modified huAFD.v1 Heavy Chain
EVQLVQSGAEVKKPGASVKVSCKASGYTFTSYYMYWVRQAPGQGLEWIGEINPTNGGTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSKYGPP

SEQ ID NO: 710 - protein, 222 aa, Artificial Sequence
  C terminal-modified huAFD.v1.1 Heavy Chain
EVQLVQSGAEVKKPGASVKVSCKASGYTFTSYYMYWVRQAPGQGLEWIGEINPTQGGTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSKYGPP

SEQ ID NO: 711 - protein, 222 aa, Artificial Sequence
  C terminal-modified huAFD.v2.2 Heavy Chain
EVQLVQSGAEVKKPGASVKVSCKASGYTFTSYYMYWVRQAPGQGLEWIGEINPTSGDTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSKYGPP

SEQ ID NO: 712 - protein, 222 aa, Artificial Sequence
  C terminal-modified huAFD.v2.4 Heavy Chain
EVQLVQSGAEVKKPGASVKVSCKASGYTFTSYYMYWVRQAPGQGLEWIGEINPTSGETNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSKYGPP

SEQ ID NO: 713 - protein, 222 aa, Artificial Sequence
  C terminal-modified huAFD.v2.5 Heavy Chain
EVQLVQSGAEVKKPGASVKVSCKASGYTFTSYYMYWVRQAPGQGLEWIGEINPYSGGTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSKYGPP

SEQ ID NO: 714 - protein, 222 aa, Artificial Sequence; identical to SEQ ID NO: 706
  C terminal-modified huAFD.v2.6 Heavy Chain

SEQ ID NO: 715 - protein, 222 aa, Artificial Sequence; identical to SEQ ID NO: 706
  C terminal-modified huAFD.v2.7 Heavy Chain

SEQ ID NO: 716 - protein, 222 aa, Artificial Sequence; identical to SEQ ID NO: 706
  C terminal-modified huAFD.v2.8 Heavy Chain

SEQ ID NO: 717 - protein, 222 aa, Artificial Sequence
  C terminal-modified huAFD.v2.9 Heavy Chain
EVQLVQSGAEVKKPGASVKVSCKASGYTFTSYYMYWVRQAPGQGLEWIGWINPTSGGTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSKYGPP

SEQ ID NO: 718 - protein, 222 aa, Artificial Sequence; identical to SEQ ID NO: 706
  C terminal-modified huAFD.v2.10 Heavy Chain

SEQ ID NO: 719 - protein, 222 aa, Artificial Sequence; identical to SEQ ID NO: 706
  C terminal-modified huAFD.v2.11 Heavy Chain

SEQ ID NO: 720 - protein, 222 aa, Artificial Sequence; identical to SEQ ID NO: 713
  C terminal-modified huAFD.v2.12 Heavy Chain

SEQ ID NO: 721 - protein, 222 aa, Artificial Sequence; identical to SEQ ID NO: 706
  C terminal-modified huAFD.v2.13 Heavy Chain

SEQ ID NO: 722 - protein, 222 aa, Artificial Sequence; identical to SEQ ID NO: 712
  C terminal-modified huAFD.v2.14 Heavy Chain

SEQ ID NO: 723 - protein, 222 aa, Artificial Sequence
  C terminal-modified huAFD.v2.15 Heavy Chain
EVQLVQSGAEVKKPGASVKVSCKASGYTFTSYYMYWVRQAPGQGLEWIGEINPYSGETNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSKYGPP

SEQ ID NO: 724 - protein, 221 aa, Artificial Sequence
  C terminal-modified AFD-WT Heavy Chain
EVQLVQSGPELKKPGASVKVSCKASGYTFTNYGMNWVRQAPGQGLEWMGWINTYTGETTYADDFKGRFVFSLDTSVSTAYLQISSLKAEDTAVYYCEREGGVNNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSKYGP

SEQ ID NO: 725 - protein, 221 aa, Artificial Sequence; identical to SEQ ID NO: 724
  C terminal-modified AFD.v1 Heavy Chain

SEQ ID NO: 726 - protein, 221 aa, Artificial Sequence; identical to SEQ ID NO: 724
  C terminal-modified AFD.v2 Heavy Chain

SEQ ID NO: 727 - protein, 221 aa, Artificial Sequence; identical to SEQ ID NO: 724
  C terminal-modified AFD.v3 Heavy Chain

SEQ ID NO: 728 - protein, 221 aa, Artificial Sequence; identical to SEQ ID NO: 724
  C terminal-modified AFD.v4 Heavy Chain

SEQ ID NO: 729 - protein, 221 aa, Artificial Sequence; identical to SEQ ID NO: 724
  C terminal-modified AFD.v5 Heavy Chain

SEQ ID NO: 730 - protein, 221 aa, Artificial Sequence
  C terminal-modified AFD.v6 Heavy Chain
EVQLVQSGPELKKPGASVKVSCKASGYTFTNYGMNWVRQAPGQGLEWMGWINTYTGETTYAEDFKGRFVFSLDTSVSTAYLQISSLKAEDTAVYYCEREGGVNNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSKYGP

SEQ ID NO: 731 - protein, 221 aa, Artificial Sequence; identical to SEQ ID NO: 730
  C terminal-modified AFD.v7 Heavy Chain

SEQ ID NO: 732 - protein, 221 aa, Artificial Sequence; identical to SEQ ID NO: 730
  C terminal-modified AFD.v8 Heavy Chain

SEQ ID NO: 733 - protein, 221 aa, Artificial Sequence; identical to SEQ ID NO: 730
  C terminal-modified AFD.v9 Heavy Chain

SEQ ID NO: 734 - protein, 221 aa, Artificial Sequence; identical to SEQ ID NO: 730
  C terminal-modified AFD.v10 Heavy Chain

SEQ ID NO: 735 - protein, 221 aa, Artificial Sequence
  C terminal-modified AFD.v11 Heavy Chain
EVQLVQSGPELKKPGASVKVSCKASGYTFTNYGMNWVRQAPGQGLEWMGWISTYTGETTYAEDFKGRFVFSLDTSVSTAYLQISSLKAEDTAVYYCEREGGVNNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSKYGP

SEQ ID NO: 736 - protein, 221 aa, Artificial Sequence
  C terminal-modified AFD.v12 Heavy Chain
EVQLVQSGPELKKPGASVKVSCKASGYTFTNYGMNWVRQAPGQGLEWMGWINTYTGETTYAEDFKGRFVFSLDTSVSTAYLQISSLKAEDTAVYYCEREGGVDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSKYGP

SEQ ID NO: 737 - protein, 221 aa, Artificial Sequence
  C terminal-modified AFD.v13 Heavy Chain
EVQLVQSGPELKKPGASVKVSCKASGYTFTNYGMNWVRQAPGQGLEWMGWINTYTGETTYAEDFKGRFVFSLDTSVSTAYLQISSLKAEDTAVYYCEREGGVQNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSKYGP

SEQ ID NO: 738 - protein, 221 aa, Artificial Sequence
  C terminal-modified AFD.v14 Heavy Chain
EVQLVQSGPELKKPGASVKVSCKASGYTFTNYGMNWVRQAPGQGLEWMGWINTYTGETTYAEDFKGRFVFSLDTSVSTAYLQISSLKAEDTAVYYCEREGGVSNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSKYGP

SEQ ID NO: 739 - protein, 221 aa, Artificial Sequence; identical to SEQ ID NO: 738
  C terminal-modified AFD.v15 Heavy Chain

SEQ ID NO: 740 - protein, 221 aa, Artificial Sequence
  C terminal-modified huAFD.v2.0 Heavy Chain
EVQLVQSGAEVKKPGASVKVSCKASGYTFTSYYMYWVRQAPGQGLEWIGEINPTSGGTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSKYGP

SEQ ID NO: 741 - protein, 221 aa, Artificial Sequence; identical to SEQ ID NO: 740
  C terminal-modified huAFD.v2.1 Heavy Chain

SEQ ID NO: 742 - protein, 221 aa, Artificial Sequence
  C terminal-modified huAFD.v2.3 Heavy Chain
EVQLVQSGAEVKKPGASVKVSCKASGYTFTSYYMYWVRQAPGQGLEWIGEINPYSGDTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSKYGP

SEQ ID NO: 743 - protein, 221 aa, Artificial Sequence
  C terminal-modified huAFD.v1 Heavy Chain
EVQLVQSGAEVKKPGASVKVSCKASGYTFTSYYMYWVRQAPGQGLEWIGEINPTNGGTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSKYGP

SEQ ID NO: 744 - protein, 221 aa, Artificial Sequence
  C terminal-modified huAFD.v1.1 Heavy Chain
EVQLVQSGAEVKKPGASVKVSCKASGYTFTSYYMYWVRQAPGQGLEWIGEINPTQGGTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSKYGP

SEQ ID NO: 745 - protein, 221 aa, Artificial Sequence
  C terminal-modified huAFD.v2.2 Heavy Chain
EVQLVQSGAEVKKPGASVKVSCKASGYTFTSYYMYWVRQAPGQGLEWIGEINPTSGDTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSKYGP

SEQ ID NO: 746 - protein, 221 aa, Artificial Sequence
  C terminal-modified huAFD.v2.4 Heavy Chain
EVQLVQSGAEVKKPGASVKVSCKASGYTFTSYYMYWVRQAPGQGLEWIGEINPTSGETNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSKYGP

SEQ ID NO: 747 - protein, 221 aa, Artificial Sequence
  C terminal-modified huAFD.v2.5 Heavy Chain
EVQLVQSGAEVKKPGASVKVSCKASGYTFTSYYMYWVRQAPGQGLEWIGEINPYSGGTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSKYGP

SEQ ID NO: 748 - protein, 221 aa, Artificial Sequence; identical to SEQ ID NO: 740
  C terminal-modified huAFD.v2.6 Heavy Chain

SEQ ID NO: 749 - protein, 221 aa, Artificial Sequence; identical to SEQ ID NO: 740
  C terminal-modified huAFD.v2.7 Heavy Chain

SEQ ID NO: 750 - protein, 221 aa, Artificial Sequence; identical to SEQ ID NO: 740
  C terminal-modified huAFD.v2.8 Heavy Chain

SEQ ID NO: 751 - protein, 221 aa, Artificial Sequence
  C terminal-modified huAFD.v2.9 Heavy Chain
EVQLVQSGAEVKKPGASVKVSCKASGYTFTSYYMYWVRQAPGQGLEWIGWINPTSGGTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSKYGP

SEQ ID NO: 752 - protein, 221 aa, Artificial Sequence; identical to SEQ ID NO: 740
  C terminal-modified huAFD.v2.10 Heavy Chain

SEQ ID NO: 753 - protein, 221 aa, Artificial Sequence; identical to SEQ ID NO: 740
  C terminal-modified huAFD.v2.11 Heavy Chain

SEQ ID NO: 754 - protein, 221 aa, Artificial Sequence; identical to SEQ ID NO: 747
  C terminal-modified huAFD.v2.12 Heavy Chain

SEQ ID NO: 755 - protein, 221 aa, Artificial Sequence; identical to SEQ ID NO: 740
  C terminal-modified huAFD.v2.13 Heavy Chain

SEQ ID NO: 756 - protein, 221 aa, Artificial Sequence; identical to SEQ ID NO: 746
  C terminal-modified huAFD.v2.14 Heavy Chain

SEQ ID NO: 757 - protein, 221 aa, Artificial Sequence
  C terminal-modified huAFD.v2.15 Heavy Chain
EVQLVQSGAEVKKPGASVKVSCKASGYTFTSYYMYWVRQAPGQGLEWIGEINPYSGETNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSKYGP

SEQ ID NO: 758 - protein, 220 aa, Artificial Sequence
  C terminal-modified AFD-WT Heavy Chain
EVQLVQSGPELKKPGASVKVSCKASGYTFTNYGMNWVRQAPGQGLEWMGWINTYTGETTYADDFKGRFVFSLDTSVSTAYLQISSLKAEDTAVYYCEREGGVNNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSKYG

SEQ ID NO: 759 - protein, 220 aa, Artificial Sequence; identical to SEQ ID NO: 758
  C terminal-modified AFD.v1 Heavy Chain

SEQ ID NO: 760 - protein, 220 aa, Artificial Sequence; identical to SEQ ID NO: 758
  C terminal-modified AFD.v2 Heavy Chain

SEQ ID NO: 761 - protein, 220 aa, Artificial Sequence; identical to SEQ ID NO: 758
  C terminal-modified AFD.v3 Heavy Chain

SEQ ID NO: 762 - protein, 220 aa, Artificial Sequence; identical to SEQ ID NO: 758
  C terminal-modified AFD.v4 Heavy Chain

SEQ ID NO: 763 - protein, 220 aa, Artificial Sequence; identical to SEQ ID NO: 758
  C terminal-modified AFD.v5 Heavy Chain

SEQ ID NO: 764 - protein, 220 aa, Artificial Sequence
  C terminal-modified AFD.v6 Heavy Chain
EVQLVQSGPELKKPGASVKVSCKASGYTFTNYGMNWVRQAPGQGLEWMGWINTYTGETTYAEDFKGRFVFSLDTSVSTAYLQISSLKAEDTAVYYCEREGGVNNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSKYG

SEQ ID NO: 765 - protein, 220 aa, Artificial Sequence; identical to SEQ ID NO: 764
  C terminal-modified AFD.v7 Heavy Chain

SEQ ID NO: 766 - protein, 220 aa, Artificial Sequence; identical to SEQ ID NO: 764
  C terminal-modified AFD.v8 Heavy Chain

SEQ ID NO: 767 - protein, 220 aa, Artificial Sequence; identical to SEQ ID NO: 764
  C terminal-modified AFD.v9 Heavy Chain

SEQ ID NO: 768 - protein, 220 aa, Artificial Sequence; identical to SEQ ID NO: 764
  C terminal-modified AFD.v10 Heavy Chain

SEQ ID NO: 769 - protein, 220 aa, Artificial Sequence
  C terminal-modified AFD.v11 Heavy Chain
EVQLVQSGPELKKPGASVKVSCKASGYTFTNYGMNWVRQAPGQGLEWMGWISTYTGETTYAEDFKGRFVFSLDTSVSTAYLQISSLKAEDTAVYYCEREGGVNNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSKYG

SEQ ID NO: 770 - protein, 220 aa, Artificial Sequence
  C terminal-modified AFD.v12 Heavy Chain
EVQLVQSGPELKKPGASVKVSCKASGYTFTNYGMNWVRQAPGQGLEWMGWINTYTGETTYAEDFKGRFVFSLDTSVSTAYLQISSLKAEDTAVYYCEREGGVDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSKYG

SEQ ID NO: 771 - protein, 220 aa, Artificial Sequence
  C terminal-modified AFD.v13 Heavy Chain
EVQLVQSGPELKKPGASVKVSCKASGYTFTNYGMNWVRQAPGQGLEWMGWINTYTGETTYAEDFKGRFVFSLDTSVSTAYLQISSLKAEDTAVYYCEREGGVQNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSKYG

SEQ ID NO: 772 - protein, 220 aa, Artificial Sequence
  C terminal-modified AFD.v14 Heavy Chain
EVQLVQSGPELKKPGASVKVSCKASGYTFTNYGMNWVRQAPGQGLEWMGWINTYTGETTYAEDFKGRFVFSLDTSVSTAYLQISSLKAEDTAVYYCEREGGVSNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSKYG

SEQ ID NO: 773 - protein, 220 aa, Artificial Sequence; identical to SEQ ID NO: 772
  C terminal-modified AFD.v15 Heavy Chain

SEQ ID NO: 774 - protein, 220 aa, Artificial Sequence
  C terminal-modified huAFD.v2.0 Heavy Chain
EVQLVQSGAEVKKPGASVKVSCKASGYTFTSYYMYWVRQAPGQGLEWIGEINPTSGGTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSKYG

SEQ ID NO: 775 - protein, 220 aa, Artificial Sequence; identical to SEQ ID NO: 774
  C terminal-modified huAFD.v2.1 Heavy Chain

SEQ ID NO: 776 - protein, 220 aa, Artificial Sequence
  C terminal-modified huAFD.v2.3 Heavy Chain
EVQLVQSGAEVKKPGASVKVSCKASGYTFTSYYMYWVRQAPGQGLEWIGEINPYSGDTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSKYG

SEQ ID NO: 777 - protein, 220 aa, Artificial Sequence
  C terminal-modified huAFD.v1 Heavy Chain
EVQLVQSGAEVKKPGASVKVSCKASGYTFTSYYMYWVRQAPGQGLEWIGEINPTNGGTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSKYG

SEQ ID NO: 778 - protein, 220 aa, Artificial Sequence
  C terminal-modified huAFD.v1.1 Heavy Chain
EVQLVQSGAEVKKPGASVKVSCKASGYTFTSYYMYWVRQAPGQGLEWIGEINPTQGGTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSKYG

SEQ ID NO: 779 - protein, 220 aa, Artificial Sequence
  C terminal-modified huAFD.v2.2 Heavy Chain
EVQLVQSGAEVKKPGASVKVSCKASGYTFTSYYMYWVRQAPGQGLEWIGEINPTSGDTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSKYG

SEQ ID NO: 780 - protein, 220 aa, Artificial Sequence
  C terminal-modified huAFD.v2.4 Heavy Chain
EVQLVQSGAEVKKPGASVKVSCKASGYTFTSYYMYWVRQAPGQGLEWIGEINPTSGETNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSKYG

SEQ ID NO: 781 - protein, 220 aa, Artificial Sequence
  C terminal-modified huAFD.v2.5 Heavy Chain
EVQLVQSGAEVKKPGASVKVSCKASGYTFTSYYMYWVRQAPGQGLEWIGEINPYSGGTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSKYG

SEQ ID NO: 782 - protein, 220 aa, Artificial Sequence; identical to SEQ ID NO: 774
  C terminal-modified huAFD.v2.6 Heavy Chain

SEQ ID NO: 783 - protein, 220 aa, Artificial Sequence; identical to SEQ ID NO: 774
  C terminal-modified huAFD.v2.7 Heavy Chain

SEQ ID NO: 784 - protein, 220 aa, Artificial Sequence; identical to SEQ ID NO: 774
  C terminal-modified huAFD.v2.8 Heavy Chain

SEQ ID NO: 785 - protein, 220 aa, Artificial Sequence
  C terminal-modified huAFD.v2.9 Heavy Chain
EVQLVQSGAEVKKPGASVKVSCKASGYTFTSYYMYWVRQAPGQGLEWIGWINPTSGGTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSKYG

SEQ ID NO: 786 - protein, 220 aa, Artificial Sequence; identical to SEQ ID NO: 774
  C terminal-modified huAFD.v2.10 Heavy Chain

SEQ ID NO: 787 - protein, 220 aa, Artificial Sequence; identical to SEQ ID NO: 774
  C terminal-modified huAFD.v2.11 Heavy Chain

SEQ ID NO: 788 - protein, 220 aa, Artificial Sequence; identical to SEQ ID NO: 781
  C terminal-modified huAFD.v2.12 Heavy Chain

SEQ ID NO: 789 - protein, 220 aa, Artificial Sequence; identical to SEQ ID NO: 774
  C terminal-modified huAFD.v2.13 Heavy Chain

SEQ ID NO: 790 - protein, 220 aa, Artificial Sequence; identical to SEQ ID NO: 780
  C terminal-modified huAFD.v2.14 Heavy Chain

SEQ ID NO: 791 - protein, 220 aa, Artificial Sequence
  C terminal-modified huAFD.v2.15 Heavy Chain
EVQLVQSGAEVKKPGASVKVSCKASGYTFTSYYMYWVRQAPGQGLEWIGEINPYSGETNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSKYG

SEQ ID NO: 792 - protein, 219 aa, Artificial Sequence
  C terminal-modified AFD-WT Heavy Chain
EVQLVQSGPELKKPGASVKVSCKASGYTFTNYGMNWVRQAPGQGLEWMGWINTYTGETTYADDFKGRFVFSLDTSVSTAYLQISSLKAEDTAVYYCEREGGVNNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSKY

SEQ ID NO: 793 - protein, 219 aa, Artificial Sequence; identical to SEQ ID NO: 792
  C terminal-modified AFD.v1 Heavy Chain

SEQ ID NO: 794 - protein, 219 aa, Artificial Sequence; identical to SEQ ID NO: 792
  C terminal-modified AFD.v2 Heavy Chain

SEQ ID NO: 795 - protein, 219 aa, Artificial Sequence; identical to SEQ ID NO: 792
  C terminal-modified AFD.v3 Heavy Chain

SEQ ID NO: 796 - protein, 219 aa, Artificial Sequence; identical to SEQ ID NO: 792
  C terminal-modified AFD.v4 Heavy Chain

SEQ ID NO: 797 - protein, 219 aa, Artificial Sequence; identical to SEQ ID NO: 792
  C terminal-modified AFD.v5 Heavy Chain

SEQ ID NO: 798 - protein, 219 aa, Artificial Sequence
  C terminal-modified AFD.v6 Heavy Chain
EVQLVQSGPELKKPGASVKVSCKASGYTFTNYGMNWVRQAPGQGLEWMGWINTYTGETTYAEDFKGRFVFSLDTSVSTAYLQISSLKAEDTAVYYCEREGGVNNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSKY

SEQ ID NO: 799 - protein, 219 aa, Artificial Sequence; identical to SEQ ID NO: 798
  C terminal-modified AFD.v7 Heavy Chain

SEQ ID NO: 800 - protein, 219 aa, Artificial Sequence; identical to SEQ ID NO: 798
  C terminal-modified AFD.v8 Heavy Chain

SEQ ID NO: 801 - protein, 219 aa, Artificial Sequence; identical to SEQ ID NO: 798
  C terminal-modified AFD.v9 Heavy Chain

SEQ ID NO: 802 - protein, 219 aa, Artificial Sequence; identical to SEQ ID NO: 798
  C terminal-modified AFD.v10 Heavy Chain

SEQ ID NO: 803 - protein, 219 aa, Artificial Sequence
  C terminal-modified AFD.v11 Heavy Chain
EVQLVQSGPELKKPGASVKVSCKASGYTFTNYGMNWVRQAPGQGLEWMGWISTYTGETTYAEDFKGRFVFSLDTSVSTAYLQISSLKAEDTAVYYCEREGGVNNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSKY

SEQ ID NO: 804 - protein, 219 aa, Artificial Sequence
  C terminal-modified AFD.v12 Heavy Chain
EVQLVQSGPELKKPGASVKVSCKASGYTFTNYGMNWVRQAPGQGLEWMGWINTYTGETTYAEDFKGRFVFSLDTSVSTAYLQISSLKAEDTAVYYCEREGGVDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSKY

SEQ ID NO: 805 - protein, 219 aa, Artificial Sequence
  C terminal-modified AFD.v13 Heavy Chain
EVQLVQSGPELKKPGASVKVSCKASGYTFTNYGMNWVRQAPGQGLEWMGWINTYTGETTYAEDFKGRFVFSLDTSVSTAYLQISSLKAEDTAVYYCEREGGVQNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSKY

SEQ ID NO: 806 - protein, 219 aa, Artificial Sequence
  C terminal-modified AFD.v14 Heavy Chain
EVQLVQSGPELKKPGASVKVSCKASGYTFTNYGMNWVRQAPGQGLEWMGWINTYTGETTYAEDFKGRFVFSLDTSVSTAYLQISSLKAEDTAVYYCEREGGVSNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSKY

SEQ ID NO: 807 - protein, 219 aa, Artificial Sequence; identical to SEQ ID NO: 806
  C terminal-modified AFD.v15 Heavy Chain

SEQ ID NO: 808 - protein, 219 aa, Artificial Sequence
  C terminal-modified huAFD.v2.0 Heavy Chain
EVQLVQSGAEVKKPGASVKVSCKASGYTFTSYYMYWVRQAPGQGLEWIGEINPTSGGTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSKY

SEQ ID NO: 809 - protein, 219 aa, Artificial Sequence; identical to SEQ ID NO: 808
  C terminal-modified huAFD.v2.1 Heavy Chain

SEQ ID NO: 810 - protein, 219 aa, Artificial Sequence
  C terminal-modified huAFD.v2.3 Heavy Chain
EVQLVQSGAEVKKPGASVKVSCKASGYTFTSYYMYWVRQAPGQGLEWIGEINPYSGDTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSKY

SEQ ID NO: 811 - protein, 219 aa, Artificial Sequence
  C terminal-modified huAFD.v1 Heavy Chain
EVQLVQSGAEVKKPGASVKVSCKASGYTFTSYYMYWVRQAPGQGLEWIGEINPTNGGTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSKY

SEQ ID NO: 812 - protein, 219 aa, Artificial Sequence
  C terminal-modified huAFD.v1.1 Heavy Chain
EVQLVQSGAEVKKPGASVKVSCKASGYTFTSYYMYWVRQAPGQGLEWIGEINPTQGGTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSKY

SEQ ID NO: 813 - protein, 219 aa, Artificial Sequence
  C terminal-modified huAFD.v2.2 Heavy Chain
EVQLVQSGAEVKKPGASVKVSCKASGYTFTSYYMYWVRQAPGQGLEWIGEINPTSGDTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSKY

SEQ ID NO: 814 - protein, 219 aa, Artificial Sequence
  C terminal-modified huAFD.v2.4 Heavy Chain
EVQLVQSGAEVKKPGASVKVSCKASGYTFTSYYMYWVRQAPGQGLEWIGEINPTSGETNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSKY

SEQ ID NO: 815 - protein, 219 aa, Artificial Sequence
  C terminal-modified huAFD.v2.5 Heavy Chain
EVQLVQSGAEVKKPGASVKVSCKASGYTFTSYYMYWVRQAPGQGLEWIGEINPYSGGTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSKY

SEQ ID NO: 816 - protein, 219 aa, Artificial Sequence; identical to SEQ ID NO: 808
  C terminal-modified huAFD.v2.6 Heavy Chain

SEQ ID NO: 817 - protein, 219 aa, Artificial Sequence; identical to SEQ ID NO: 808
  C terminal-modified huAFD.v2.7 Heavy Chain

SEQ ID NO: 818 - protein, 219 aa, Artificial Sequence; identical to SEQ ID NO: 808
  C terminal-modified huAFD.v2.8 Heavy Chain

SEQ ID NO: 819 - protein, 219 aa, Artificial Sequence
  C terminal-modified huAFD.v2.9 Heavy Chain
EVQLVQSGAEVKKPGASVKVSCKASGYTFTSYYMYWVRQAPGQGLEWIGWINPTSGGTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSKY

SEQ ID NO: 820 - protein, 219 aa, Artificial Sequence; identical to SEQ ID NO: 808
  C terminal-modified huAFD.v2.10 Heavy Chain

SEQ ID NO: 821 - protein, 219 aa, Artificial Sequence; identical to SEQ ID NO: 808
  C terminal-modified huAFD.v2.11 Heavy Chain

SEQ ID NO: 822 - protein, 219 aa, Artificial Sequence; identical to SEQ ID NO: 815
  C terminal-modified huAFD.v2.12 Heavy Chain

SEQ ID NO: 823 - protein, 219 aa, Artificial Sequence; identical to SEQ ID NO: 808
  C terminal-modified huAFD.v2.13 Heavy Chain

SEQ ID NO: 824 - protein, 219 aa, Artificial Sequence; identical to SEQ ID NO: 814
  C terminal-modified huAFD.v2.14 Heavy Chain

SEQ ID NO: 825 - protein, 219 aa, Artificial Sequence
  C terminal-modified huAFD.v2.15 Heavy Chain
EVQLVQSGAEVKKPGASVKVSCKASGYTFTSYYMYWVRQAPGQGLEWIGEINPYSGETNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSKY

SEQ ID NO: 826 - protein, 218 aa, Artificial Sequence
  C terminal-modified AFD-WT Heavy Chain
EVQLVQSGPELKKPGASVKVSCKASGYTFTNYGMNWVRQAPGQGLEWMGWINTYTGETTYADDFKGRFVFSLDTSVSTAYLQISSLKAEDTAVYYCEREGGVNNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSK

SEQ ID NO: 827 - protein, 218 aa, Artificial Sequence; identical to SEQ ID NO: 826
  C terminal-modified AFD.v1 Heavy Chain

SEQ ID NO: 828 - protein, 218 aa, Artificial Sequence; identical to SEQ ID NO: 826
  C terminal-modified AFD.v2 Heavy Chain

SEQ ID NO: 829 - protein, 218 aa, Artificial Sequence; identical to SEQ ID NO: 826
  C terminal-modified AFD.v3 Heavy Chain

SEQ ID NO: 830 - protein, 218 aa, Artificial Sequence; identical to SEQ ID NO: 826
  C terminal-modified AFD.v4 Heavy Chain

SEQ ID NO: 831 - protein, 218 aa, Artificial Sequence; identical to SEQ ID NO: 826
  C terminal-modified AFD.v5 Heavy Chain

SEQ ID NO: 832 - protein, 218 aa, Artificial Sequence
  C terminal-modified AFD.v6 Heavy Chain
EVQLVQSGPELKKPGASVKVSCKASGYTFTNYGMNWVRQAPGQGLEWMGWINTYTGETTYAEDFKGRFVFSLDTSVSTAYLQISSLKAEDTAVYYCEREGGVNNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSK

SEQ ID NO: 833 - protein, 218 aa, Artificial Sequence; identical to SEQ ID NO: 832
  C terminal-modified AFD.v7 Heavy Chain

SEQ ID NO: 834 - protein, 218 aa, Artificial Sequence; identical to SEQ ID NO: 832
  C terminal-modified AFD.v8 Heavy Chain

SEQ ID NO: 835 - protein, 218 aa, Artificial Sequence; identical to SEQ ID NO: 832
  C terminal-modified AFD.v9 Heavy Chain

SEQ ID NO: 836 - protein, 218 aa, Artificial Sequence; identical to SEQ ID NO: 832
  C terminal-modified AFD.v10 Heavy Chain

SEQ ID NO: 837 - protein, 218 aa, Artificial Sequence
  C terminal-modified AFD.v11 Heavy Chain
EVQLVQSGPELKKPGASVKVSCKASGYTFTNYGMNWVRQAPGQGLEWMGWISTYTGETTYAEDFKGRFVFSLDTSVSTAYLQISSLKAEDTAVYYCEREGGVNNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSK

SEQ ID NO: 838 - protein, 218 aa, Artificial Sequence
  C terminal-modified AFD.v12 Heavy Chain
EVQLVQSGPELKKPGASVKVSCKASGYTFTNYGMNWVRQAPGQGLEWMGWINTYTGETTYAEDFKGRFVFSLDTSVSTAYLQISSLKAEDTAVYYCEREGGVDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSK

SEQ ID NO: 839 - protein, 218 aa, Artificial Sequence
  C terminal-modified AFD.v13 Heavy Chain
EVQLVQSGPELKKPGASVKVSCKASGYTFTNYGMNWVRQAPGQGLEWMGWINTYTGETTYAEDFKGRFVFSLDTSVSTAYLQISSLKAEDTAVYYCEREGGVQNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSK

SEQ ID NO: 840 - protein, 218 aa, Artificial Sequence
  C terminal-modified AFD.v14 Heavy Chain
EVQLVQSGPELKKPGASVKVSCKASGYTFTNYGMNWVRQAPGQGLEWMGWINTYTGETTYAEDFKGRFVFSLDTSVSTAYLQISSLKAEDTAVYYCEREGGVSNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSK

SEQ ID NO: 841 - protein, 218 aa, Artificial Sequence; identical to SEQ ID NO: 840
  C terminal-modified AFD.v15 Heavy Chain

SEQ ID NO: 842 - protein, 218 aa, Artificial Sequence
  C terminal-modified huAFD.v2.0 Heavy Chain
EVQLVQSGAEVKKPGASVKVSCKASGYTFTSYYMYWVRQAPGQGLEWIGEINPTSGGTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSK

SEQ ID NO: 843 - protein, 218 aa, Artificial Sequence; identical to SEQ ID NO: 842
  C terminal-modified huAFD.v2.1 Heavy Chain

SEQ ID NO: 844 - protein, 218 aa, Artificial Sequence
  C terminal-modified huAFD.v2.3 Heavy Chain
EVQLVQSGAEVKKPGASVKVSCKASGYTFTSYYMYWVRQAPGQGLEWIGEINPYSGDTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSK

SEQ ID NO: 845 - protein, 218 aa, Artificial Sequence
  C terminal-modified huAFD.v1 Heavy Chain
EVQLVQSGAEVKKPGASVKVSCKASGYTFTSYYMYWVRQAPGQGLEWIGEINPTNGGTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSK

SEQ ID NO: 846 - protein, 218 aa, Artificial Sequence
  C terminal-modified huAFD.v1.1 Heavy Chain
EVQLVQSGAEVKKPGASVKVSCKASGYTFTSYYMYWVRQAPGQGLEWIGEINPTQGGTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSK

SEQ ID NO: 847 - protein, 218 aa, Artificial Sequence
  C terminal-modified huAFD.v2.2 Heavy Chain
EVQLVQSGAEVKKPGASVKVSCKASGYTFTSYYMYWVRQAPGQGLEWIGEINPTSGDTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSK

SEQ ID NO: 848 - protein, 218 aa, Artificial Sequence
  C terminal-modified huAFD.v2.4 Heavy Chain
EVQLVQSGAEVKKPGASVKVSCKASGYTFTSYYMYWVRQAPGQGLEWIGEINPTSGETNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSK

SEQ ID NO: 849 - protein, 218 aa, Artificial Sequence
  C terminal-modified huAFD.v2.5 Heavy Chain
EVQLVQSGAEVKKPGASVKVSCKASGYTFTSYYMYWVRQAPGQGLEWIGEINPYSGGTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSK

SEQ ID NO: 850 - protein, 218 aa, Artificial Sequence; identical to SEQ ID NO: 842
  C terminal-modified huAFD.v2.6 Heavy Chain

SEQ ID NO: 851 - protein, 218 aa, Artificial Sequence; identical to SEQ ID NO: 842
  C terminal-modified huAFD.v2.7 Heavy Chain

SEQ ID NO: 852 - protein, 218 aa, Artificial Sequence; identical to SEQ ID NO: 842
  C terminal-modified huAFD.v2.8 Heavy Chain

SEQ ID NO: 853 - protein, 218 aa, Artificial Sequence
  C terminal-modified huAFD.v2.9 Heavy Chain
EVQLVQSGAEVKKPGASVKVSCKASGYTFTSYYMYWVRQAPGQGLEWIGWINPTSGGTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSK

SEQ ID NO: 854 - protein, 218 aa, Artificial Sequence; identical to SEQ ID NO: 842
  C terminal-modified huAFD.v2.10 Heavy Chain

SEQ ID NO: 855 - protein, 218 aa, Artificial Sequence; identical to SEQ ID NO: 842
  C terminal-modified huAFD.v2.11 Heavy Chain

SEQ ID NO: 856 - protein, 218 aa, Artificial Sequence; identical to SEQ ID NO: 849
  C terminal-modified huAFD.v2.12 Heavy Chain

SEQ ID NO: 857 - protein, 218 aa, Artificial Sequence; identical to SEQ ID NO: 842
  C terminal-modified huAFD.v2.13 Heavy Chain

SEQ ID NO: 858 - protein, 218 aa, Artificial Sequence; identical to SEQ ID NO: 848
  C terminal-modified huAFD.v2.14 Heavy Chain

SEQ ID NO: 859 - protein, 218 aa, Artificial Sequence
  C terminal-modified huAFD.v2.15 Heavy Chain
EVQLVQSGAEVKKPGASVKVSCKASGYTFTSYYMYWVRQAPGQGLEWIGEINPYSGETNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSK

SEQ ID NO: 860 - protein, 107 aa, Artificial Sequence [sequence omitted]

SEQ ID NO: 861 - protein, 108 aa, Artificial Sequence
  heavy chain constant region
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHT

SEQ ID NO: 862 - protein, 108 aa, Artificial Sequence
  heavy chain constant region
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHL

SEQ ID NO: 863 - protein, 109 aa, Artificial Sequence
  heavy chain constant region
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTC

SEQ ID NO: 864 - protein, 112 aa, Artificial Sequence
  heavy chain constant region
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPC

SEQ ID NO: 865 - protein, 112 aa, Artificial Sequence
  heavy chain constant region
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPS

SEQ ID NO: 866 - protein, 112 aa, Artificial Sequence
  heavy chain constant region
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTSPPC

SEQ ID NO: 867 - protein, 112 aa, Artificial Sequence
  heavy chain constant region
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTAPPC

SEQ ID NO: 868 - protein, 112 aa, Artificial Sequence
  heavy chain constant region
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTSGGC

SEQ ID NO: 869 - protein, 108 aa, Artificial Sequence
  heavy chain constant region
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCYGPPC

SEQ ID NO: 870 - protein, 107 aa, Artificial Sequence
  heavy chain constant region
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 871 - protein, 106 aa, Artificial Sequence
  heavy chain constant region
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKT

SEQ ID NO: 872 - protein, 105 aa, Artificial Sequence
  heavy chain constant region
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDK

SEQ ID NO: 873 - protein, 104 aa, Artificial Sequence
  heavy chain constant region
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCD

SEQ ID NO: 874 - protein, 101 aa, Artificial Sequence
  heavy chain constant region
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERK

SEQ ID NO: 875 - protein, 102 aa, Artificial Sequence
  heavy chain constant region
ASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKC

SEQ ID NO: 876 - protein, 106 aa, Artificial Sequence
  heavy chain constant region
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPC

SEQ ID NO: 877 - protein, 105 aa, Artificial Sequence
  heavy chain constant region
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPP

SEQ ID NO: 878 - protein, 104 aa, Artificial Sequence
  heavy chain constant region
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGP

SEQ ID NO: 879 - protein, 103 aa, Artificial Sequence
  heavy chain constant region
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYG

SEQ ID NO: 880 - protein, 102 aa, Artificial Sequence
  heavy chain constant region
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKY

SEQ ID NO: 881 - protein, 101 aa, Artificial Sequence
  heavy chain constant region
ASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESK

SEQ ID NO: 882 - protein, 223 aa, Artificial Sequence
  C terminal-modified AFD WT Heavy Chain
  VARIANT 223: Xaa = any amino acid except Thr
EVQLVQSGPELKKPGASVKVSCKASGYTFTNYGMNWVRQAPGQGLEWMGWINTYTGETTYADDFKGRFVFSLDTSVSTAYLQISSLKAEDTAVYYCEREGGVNNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHX

SEQ ID NO: 883 - protein, 223 aa, Artificial Sequence; identical to SEQ ID NO: 882
  C terminal-modified AFD.v1 Heavy Chain
  VARIANT 223: Xaa = any amino acid except Thr

SEQ ID NO: 884 - protein, 223 aa, Artificial Sequence; identical to SEQ ID NO: 882
  C terminal-modified AFD.v2 Heavy Chain
  VARIANT 223: Xaa = any amino acid except Thr

SEQ ID NO: 885 - protein, 223 aa, Artificial Sequence; identical to SEQ ID NO: 882
  C terminal-modified AFD.v3 Heavy Chain
  VARIANT 223: Xaa = any amino acid except Thr

SEQ ID NO: 886 - protein, 223 aa, Artificial Sequence; identical to SEQ ID NO: 882
  C terminal-modified AFD.v4 Heavy Chain
  VARIANT 223: Xaa = any amino acid except Thr

SEQ ID NO: 887 - protein, 223 aa, Artificial Sequence; identical to SEQ ID NO: 882
  C terminal-modified AFD.v5 Heavy Chain
  VARIANT 223: Xaa = any amino acid except Thr

SEQ ID NO: 888 - protein, 223 aa, Artificial Sequence
  C terminal-modified AFD.v6 Heavy Chain
  VARIANT 223: Xaa = any amino acid except Thr
EVQLVQSGPELKKPGASVKVSCKASGYTFTNYGMNWVRQAPGQGLEWMGWINTYTGETTYAEDFKGRFVFSLDTSVSTAYLQISSLKAEDTAVYYCEREGGVNNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHX

SEQ ID NO: 889 - protein, 223 aa, Artificial Sequence; identical to SEQ ID NO: 888
  C terminal-modified AFD.v7 Heavy Chain
  VARIANT 223: Xaa = any amino acid except Thr

SEQ ID NO: 890 - protein, 223 aa, Artificial Sequence; identical to SEQ ID NO: 888
  C terminal-modified AFD.v8 Heavy Chain
  VARIANT 223: Xaa = any amino acid except Thr

SEQ ID NO: 891 - protein, 223 aa, Artificial Sequence; identical to SEQ ID NO: 888
  C terminal-modified AFD.v9 Heavy Chain
  VARIANT 223: Xaa = any amino acid except Thr

SEQ ID NO: 892 - protein, 223 aa, Artificial Sequence; identical to SEQ ID NO: 888
  C terminal-modified AFD.v10 Heavy Chain
  VARIANT 223: Xaa = any amino acid except Thr

SEQ ID NO: 893 - protein, 223 aa, Artificial Sequence
  C terminal-modified AFD.v11 Heavy Chain
  VARIANT 223: Xaa = any amino acid except Thr
EVQLVQSGPELKKPGASVKVSCKASGYTFTNYGMNWVRQAPGQGLEWMGWISTYTGETTYAEDFKGRFVFSLDTSVSTAYLQISSLKAEDTAVYYCEREGGVNNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHX

SEQ ID NO: 894 - protein, 223 aa, Artificial Sequence
  C terminal-modified AFD.v12 Heavy Chain
  VARIANT 223: Xaa = any amino acid except Thr
EVQLVQSGPELKKPGASVKVSCKASGYTFTNYGMNWVRQAPGQGLEWMGWINTYTGETTYAEDFKGRFVFSLDTSVSTAYLQISSLKAEDTAVYYCEREGGVDNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHX

SEQ ID NO: 895 - protein, 223 aa, Artificial Sequence
  C terminal-modified AFD.v13 Heavy Chain
  VARIANT 223: Xaa = any amino acid except Thr
EVQLVQSGPELKKPGASVKVSCKASGYTFTNYGMNWVRQAPGQGLEWMGWINTYTGETTYAEDFKGRFVFSLDTSVSTAYLQISSLKAEDTAVYYCEREGGVQNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHX

SEQ ID NO: 896 - protein, 223 aa, Artificial Sequence
  C terminal-modified AFD.v14 Heavy Chain
  VARIANT 223: Xaa = any amino acid except Thr
EVQLVQSGPELKKPGASVKVSCKASGYTFTNYGMNWVRQAPGQGLEWMGWINTYTGETTYAEDFKGRFVFSLDTSVSTAYLQISSLKAEDTAVYYCEREGGVSNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHX

SEQ ID NO: 897 - protein, 223 aa, Artificial Sequence; identical to SEQ ID NO: 896
  C terminal-modified AFD.v15 Heavy Chain
  VARIANT 223: Xaa = any amino acid except Thr

SEQ ID NO: 898 - protein, 223 aa, Artificial Sequence
  C terminal-modified huAFD.v2.0 Heavy Chain
  VARIANT 223: Xaa = any amino acid except Thr
EVQLVQSGAEVKKPGASVKVSCKASGYTFTSYYMYWVRQAPGQGLEWIGEINPTSGGTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHX

SEQ ID NO: 899 - protein, 223 aa, Artificial Sequence; identical to SEQ ID NO: 898
  C terminal-modified huAFD.v2.1 Heavy Chain
  VARIANT 223: Xaa = any amino acid except Thr

SEQ ID NO: 900 - protein, 223 aa, Artificial Sequence
  C terminal-modified huAFD.v2.3 Heavy Chain
  VARIANT 223: Xaa = any amino acid except Thr
EVQLVQSGAEVKKPGASVKVSCKASGYTFTSYYMYWVRQAPGQGLEWIGEINPYSGDTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHX

SEQ ID NO: 901 - protein, 223 aa, Artificial Sequence
  C terminal-modified huAFD.v1 Heavy Chain
  VARIANT 223: Xaa = any amino acid except Thr
EVQLVQSGAEVKKPGASVKVSCKASGYTFTSYYMYWVRQAPGQGLEWIGEINPTNGGTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHX

SEQ ID NO: 902 - protein, 223 aa, Artificial Sequence
  C terminal-modified huAFD.v1.1 Heavy Chain
  VARIANT 223: Xaa = any amino acid except Thr
EVQLVQSGAEVKKPGASVKVSCKASGYTFTSYYMYWVRQAPGQGLEWIGEINPTQGGTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHX

SEQ ID NO: 903 - protein, 223 aa, Artificial Sequence
  C terminal-modified huAFD.v2.2 Heavy Chain
  VARIANT 223: Xaa = any amino acid except Thr
EVQLVQSGAEVKKPGASVKVSCKASGYTFTSYYMYWVRQAPGQGLEWIGEINPTSGDTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHX

SEQ ID NO: 904 - protein, 223 aa, Artificial Sequence
  C terminal-modified huAFD.v2.4 Heavy Chain
  VARIANT 223: Xaa = any amino acid except Thr
EVQLVQSGAEVKKPGASVKVSCKASGYTFTSYYMYWVRQAPGQGLEWIGEINPTSGETNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHX

SEQ ID NO: 905 - protein, 223 aa, Artificial Sequence
  C terminal-modified huAFD.v2.5 Heavy Chain
  VARIANT 223: Xaa = any amino acid except Thr
EVQLVQSGAEVKKPGASVKVSCKASGYTFTSYYMYWVRQAPGQGLEWIGEINPYSGGTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHX

SEQ ID NO: 906 - protein, 223 aa, Artificial Sequence; identical to SEQ ID NO: 898
  C terminal-modified huAFD.v2.6 Heavy Chain
  VARIANT 223: Xaa = any amino acid except Thr

SEQ ID NO: 907 - protein, 223 aa, Artificial Sequence; identical to SEQ ID NO: 898
  C terminal-modified huAFD.v2.7 Heavy Chain
  VARIANT 223: Xaa = any amino acid except Thr

SEQ ID NO: 908 - protein, 223 aa, Artificial Sequence; identical to SEQ ID NO: 898
  C terminal-modified huAFD.v2.8 Heavy Chain
  VARIANT 223: Xaa = any amino acid except Thr

SEQ ID NO: 909 - protein, 223 aa, Artificial Sequence
  C terminal-modified huAFD.v2.9 Heavy Chain
  VARIANT 223: Xaa = any amino acid except Thr
EVQLVQSGAEVKKPGASVKVSCKASGYTFTSYYMYWVRQAPGQGLEWIGWINPTSGGTNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHX

SEQ ID NO: 910 - protein, 223 aa, Artificial Sequence; identical to SEQ ID NO: 898
  C terminal-modified huAFD.v2.10 Heavy Chain
  VARIANT 223: Xaa = any amino acid except Thr

SEQ ID NO: 911 - protein, 223 aa, Artificial Sequence; identical to SEQ ID NO: 898
  C terminal-modified huAFD.v2.11 Heavy Chain
  VARIANT 223: Xaa = any amino acid except Thr

SEQ ID NO: 912 - protein, 223 aa, Artificial Sequence; identical to SEQ ID NO: 905
  C terminal-modified huAFD.v2.12 Heavy Chain
  VARIANT 223: Xaa = any amino acid except Thr

SEQ ID NO: 913 - protein, 223 aa, Artificial Sequence; identical to SEQ ID NO: 898
  C terminal-modified huAFD.v2.13 Heavy Chain
  VARIANT 223: Xaa = any amino acid except Thr

SEQ ID NO: 914 - protein, 223 aa, Artificial Sequence; identical to SEQ ID NO: 904
  C terminal-modified huAFD.v2.14 Heavy Chain
  VARIANT 223: Xaa = any amino acid except Thr

SEQ ID NO: 915 - protein, 223 aa, Artificial Sequence
  C terminal-modified huAFD.v2.15 Heavy Chain
  VARIANT 223: Xaa = any amino acid except Thr
EVQLVQSGAEVKKPGASVKVSCKASGYTFTSYYMYWVRQAPGQGLEWIGEINPYSGETNFNEKFKSRATLTVDTSTSTAYLELSSLRSEDTAVYYCAREGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHX

SEQ ID NO: 916 - protein, 108 aa, Artificial Sequence
  anti-Factor D antibody heavy chain constant regions
  VARIANT 108: Xaa = any amino acid except Thr
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHX

What is claimed is:

1. A method of measuring the activity of Factor D in a sample derived from a subject, comprising performing a proximity-based measurement assay, wherein the proximity-based measurement assay measures the cleavage of Factor B and comprises:
   (a) adding to the sample an anti-Factor Ba antibody labeled with a first moiety and an anti-Factor Bb antibody labeled with a second moiety, wherein one of the moieties is a donor, and the other moiety is an acceptor, and wherein a proximity signal generated by the acceptor and/or the donor indicates that Factor Ba and Factor Bb are in proximity; and
   (b) measuring the value of the proximity signal from the sample;
wherein the activity of Factor D in the sample is negatively correlated with the value of the proximity signal.

2. The method of claim 1, further comprising:
   (c) adding to a control sample the anti-Factor Ba antibody labeled with the first moiety and the anti-Factor Bb antibody labeled with the second moiety; and
   (d) measuring the value of the proximity signal from the control sample;
wherein a greater value of the proximity signal from the sample relative to the control sample indicates a lower activity of Factor D in the sample relative to the control sample.

3. A method of measuring the activity of Factor D in a sample derived from a subject, comprising performing a proximity-based measurement assay that comprises:
   (a) adding to the sample an anti-Factor C3b antibody labeled with a first moiety and an anti-Factor Ba antibody labeled with a second moiety, wherein one of the moieties is a donor, and the other moiety is an acceptor, and wherein a proximity signal generated by the acceptor and/or the donor indicates that Factor C3b and Factor Ba are in proximity; and
   (b) measuring the value of the proximity signal from the sample;
wherein the activity of Factor D in the sample is negatively correlated with the value of the proximity signal.

4. A method of determining the potency of a Factor D inhibitor in inhibiting Factor D activity, comprising performing a proximity-based measurement assay, wherein the proximity-based measurement assay measures the cleavage of Factor B and comprises:
   (a) mixing the Factor D inhibitor with Factor D, Factor B, and Factor C3b in a test reaction mix;
   (b) incubating the test reaction mix;
   (c) adding to the test reaction mix an anti-Factor Ba antibody labeled with a first moiety and an anti-Factor Bb antibody labeled with a second moiety after the step of (b), wherein one of the moieties is a donor, and the other moiety is an acceptor, and wherein a proximity signal generated by the acceptor and/or the donor indicates that Factor Ba and Factor Bb are in proximity; and
   (d) measuring the value of the proximity signal from the text reaction mix; wherein the potency of the Factor D inhibitor is positively correlated with the value of the proximity signal.

5. A method of determining the potency of a Factor D inhibitor in inhibiting Factor D activity, comprising performing a proximity-based measurement assay, wherein the proximity-based measurement assay measures the cleavage of Factor B and comprises:
   (a) mixing the Factor D inhibitor with Factor D, Factor B and Factor C3b in a test reaction mix;
   (b) incubating the test reaction mix;
   (c) adding to the test reaction mix an anti-Factor C3b antibody labeled with a first moiety and an anti-Factor Ba antibody labeled with a second moiety after the step of (b), wherein one of the moieties is a donor, and the other moiety is an acceptor, and wherein a proximity signal generated by the acceptor and/or the donor indicates that Factor C3b and Factor Ba are in proximity; and
   (d) measuring the value of the proximity signal from the test reaction mix; wherein the potency of the Factor D inhibitor is positively correlated with the value of the proximity signal.

6. The method of claim 4, wherein the Factor D inhibitor is an antibody or an antigen-binding fragment thereof.

7. A method of screening for a Factor D inhibitor from a plurality of Factor D inhibitor candidates, comprising performing a proximity-based measurement assay, wherein the proximity-based measurement assay measures the cleavage of Factor B and comprises:
   (a) mixing a Factor D inhibitor candidate with Factor D, Factor B and Factor C3b in a test reaction mix;
   (b) incubating the test reaction mix;
   (c) adding to the test reaction mix an anti-Factor Ba antibody labeled with a first moiety and an anti-Factor Bb antibody labeled with a second moiety after the step of (b), wherein one of the moieties is a donor, and the other is an acceptor, and wherein a proximity signal generated by the acceptor and/or the donor indicates that Factor Ba and Factor Bb are in proximity; and
   (d) measuring the value of the proximity signal from the test reaction mix; wherein the degree of Factor D activity inhibition by a Factor D candidate is positively correlated with the value of the proximity signal.

8. A method of screening for a Factor D inhibitor from a plurality of Factor D inhibitor candidates, comprising performing a proximity-based measurement assay, wherein the proximity-based measurement assay measures the cleavage of Factor B and comprises:
   (a) mixing a Factor D inhibitor candidate with Factor D, Factor B and Factor C3b in a test reaction mix;
   (b) incubating the test reaction mix;
   (c) adding to the test reaction mix an anti-Factor C3b antibody labeled with a first moiety and an anti-Factor Ba antibody labeled with a second moiety after the step of (b), wherein one of the moieties is a donor, and the other is an acceptor, and wherein a proximity signal generated by the acceptor and/or the donor indicates that Factor C3b and Factor Ba are in proximity; and
   (d) measuring the value of the proximity signal from the test reaction mix; wherein the degree of Factor D activity inhibition by a Factor D candidate is positively correlated with the value of the proximity signal.

9. The method of claim 1, wherein the anti-Factor Ba antibody and the anti-Factor Bb antibody quench the activity of Factor D.

10. The method of claim 2, wherein the anti-Factor Ba antibody and the anti-Factor Bb antibody quench the activity of Factor D.

11. The method of claim 3, further comprising:
   (c) adding to a control sample the anti-Factor C3b antibody labeled with the first moiety and the anti-Factor Ba antibody labeled with the second moiety; and
   (d) measuring the value of the proximity signal from the control sample;
wherein a greater value of the proximity signal from the sample relative to the control sample indicates a lower activity of Factor D in the sample relative to the control sample.

12. The method of claim 1, further comprising a step of quenching the activity of Factor D in the sample by providing an excessive amount of a quencher to the sample before the step of (a).

13. The method of claim 3, further comprising a step of quenching the activity of Factor D in the sample by providing an excessive amount of a quencher to the sample before the step of (a).

14. The method of claim 2, further comprising a step of quenching the activity of Factor D in the sample by providing an excessive amount of a quencher to the sample before the step of (a), and a step of quenching the activity of Factor D in the control sample by providing an excessive amount of the quencher to the control sample before the step of (c).

15. The method of claim 11, further comprising a step of quenching the activity of Factor D in the sample by providing an excessive amount of a quencher to the sample before the step of (a), and a step of quenching the activity of Factor D in the control sample by providing an excessive amount of the quencher to the control sample before the step of (c).

16. The method of claim 12, wherein the quencher is a Factor D inhibitor.

17. The method of claim 13, wherein the quencher is a Factor D inhibitor.

18. The method of claim 14, wherein the quencher is a Factor D inhibitor.

19. The method of claim 15, wherein the quencher is a Factor D inhibitor.

20. The method of claim 1, wherein the subject is a human.

21. The method of claim 3, wherein the subject is a human.

22. The method of claim 4, comprising:
   (e) mixing a control reaction mix;
   (f) incubating the control reaction mix;
   (g) adding to the control reaction mix the anti-Factor Ba antibody labeled with the first moiety and the anti-Factor Bb antibody labeled with the second moiety after the step of (f); and
   (h) measuring the value of the proximity signal from the control test reaction mix;
wherein a greater value of the proximity signal from the test reaction mix relative to the control reaction mix indicates a greater inhibition of Factor D activity by the Factor D inhibitor in the test reaction mix relative to the control reaction mix.

23. The method of claim 4, further comprising a step of quenching the activity of Factor D in the sample by providing an excessive amount of a quencher to the sample before the step of (c).

24. The method of claim 22, further comprising a step of quenching the activity of Factor D in the sample by providing an excessive amount of a quencher to the sample before the step of (c), and a step of quenching the activity of Factor D in the control sample by providing an excessive amount of the quencher to the control sample before the step of (h).

25. The method of claim 23, wherein the quencher is a Factor D inhibitor.

26. The method of claim 24, wherein the quencher is a Factor D inhibitor.

27. The method of claim 5, wherein the Factor D inhibitor is an antibody or an antigen-binding fragment thereof.

28. The method of claim 5, further comprising:
   (e) mixing a control reaction mix;
   (f) incubating the control reaction mix;
   (g) adding to the control reaction mix the anti-Factor C3b antibody labeled with the first moiety and the anti-Factor Ba antibody labeled with the second moiety after the step of (f); and
   (h) measuring the value of the proximity signal from the control reaction mix;
wherein the potency of the Factor D inhibitor is positively correlated with the value of the proximity signal.

29. The method of claim 5, further comprising a step of quenching the activity of Factor D in the sample by providing an excessive amount of a quencher to the sample before the step of (c).

30. The method of claim 28, further comprising a step of quenching the activity of Factor D in the sample by providing an excessive amount of a quencher to the sample before the step of (c), and a step of quenching the activity of Factor D in the control sample by providing an excessive amount of the quencher to the control sample before the step of (h).

31. The method of claim 29, wherein the quencher is a Factor D inhibitor.

32. The method of claim 30, wherein the quencher is a Factor D inhibitor.

33. The method of claim 7, wherein the Factor D inhibitor candidate is an antibody or an antigen-binding fragment thereof.

34. The method of claim 7, further comprising:
   (e) mixing a control reaction mix;
   (f) incubating the control reaction mix;
   (g) adding to the control reaction mix the anti-Factor Ba antibody labeled with the first moiety and the anti-Factor Bb antibody labeled with the second moiety after the step of (g); and
   (h) measuring the value of the proximity signal from the control test reaction mix;
wherein a greater value of the proximity signal from the test reaction mix relative to the control reaction mix indicates a greater inhibition of Factor D activity by the Factor D inhibitor candidate in the test reaction mix relative to the control reaction mix.

35. The method of claim 7, wherein the anti-Factor Ba antibody and the anti-Factor Bb antibody quench the activity of Factor D.

36. The method of claim 34, wherein the anti-Factor Ba antibody and the anti-Factor Bb antibody quench the activity of Factor D.

37. The method of claim 7, further comprising a step of quenching the activity of Factor D in the sample by providing an excessive amount of a quencher to the sample before the step of (c).

38. The method of claim 37, wherein the quencher is a Factor D inhibitor.

39. The method of claim 34, further comprising a step of quenching the activity of Factor D in the sample by providing an excessive amount of a quencher to the sample before the step of (c), and a step of quenching the activity of Factor D in the control sample by providing an excessive amount of the quencher to the control sample before the step of (g).

40. The method of claim 39, wherein the quencher is a Factor D inhibitor.

41. The method of claim 7, wherein the steps of (a)-(d) are carried out for each Factor D inhibitor candidate from the plurality.

42. The method of claim 8, wherein the Factor D inhibitor candidate is an antibody or an antigen-binding fragment thereof.

43. The method of claim 8, further comprising:
   (e) mixing a control reaction mix;
   (f) incubating the control reaction mix;
   (g) adding to the control reaction mix the anti-Factor C3b antibody labeled with the first moiety and the anti-Factor Ba antibody labeled with the second moiety after the step of (g); and
   (h) measuring the value of the proximity signal from the control test reaction mix;
wherein a greater value of the proximity signal from the test reaction mix relative to the control reaction mix indicates a greater inhibition of Factor D activity by the Factor D inhibitor candidate in the test reaction mix relative to the control reaction mix.

44. The method of claim 8, further comprising a step of quenching the activity of Factor D in the sample by providing an excessive amount of a quencher to the sample before the step of (c).

45. The method of claim 44, wherein the quencher is a Factor D inhibitor.

46. The method of claim 43, further comprising a step of quenching the activity of Factor D in the sample by providing an excessive amount of a quencher to the sample before the step of (c), and a step of quenching the activity of Factor D in the control sample by providing an excessive amount of the quencher to the control sample before the step of (g).

47. The method of claim 46, wherein the quencher is a Factor D inhibitor.

48. The method of claim 8, wherein the steps of (a)-(d) are carried out for each Factor D inhibitor candidate from the plurality.

* * * * *